(12) United States Patent
Johnston et al.

(10) Patent No.: US 12,173,069 B2
(45) Date of Patent: Dec. 24, 2024

(54) ANTIBODIES BINDING TO VISTA AT ACIDIC pH

(71) Applicants: Five Prime Therapeutics, Inc., South San Francisco, CA (US); Bristol-Myers Squibb Company, Princeton, NJ (US)

(72) Inventors: Robert J. Johnston, San Mateo, CA (US); Arvind Rajpal, San Francisco, CA (US); Paul O. Sheppard, Granite Falls, WA (US); Luis Borges, Houston, TX (US); Andrew Rankin, Redwood City, CA (US); Keith Sadoon Bahjat, Woodside, CA (US); Alan J. Korman, Piedmont, CA (US); Xiaodi Deng, San Mateo, CA (US); Lin Hui Su, Somerville, MA (US); Ginger Rakestraw, Somerville, MA (US); Jason R. Pinckney, Westborough, MA (US); David A. Critton, Pennington, NJ (US); Guodong Chen, East Brunswick, NJ (US); Richard Y. Huang, Bridgewater, NJ (US); Ekaterina G. Deyanova, Lawrenceville, NJ (US)

(73) Assignees: Five Prime Therapeutics, Inc., Thousand Oaks, CA (US); Bristol-Myers Squibb Company, Princeton, NJ (US)

( * ) Notice: Subject to any disclaimer, the term of this patent is extended or adjusted under 35 U.S.C. 154(b) by 1031 days.

(21) Appl. No.: 16/982,277

(22) PCT Filed: Mar. 19, 2019

(86) PCT No.: PCT/US2019/022895
§ 371 (c)(1),
(2) Date: Sep. 18, 2020

(87) PCT Pub. No.: WO2019/183040
PCT Pub. Date: Sep. 26, 2019

(65) Prior Publication Data
US 2021/0017283 A1 Jan. 21, 2021

Related U.S. Application Data

(60) Provisional application No. 62/733,462, filed on Sep. 19, 2018, provisional application No. 62/696,597, filed on Jul. 11, 2018, provisional application No. 62/646,344, filed on Mar. 21, 2018.

(51) Int. Cl.
C07K 16/28 (2006.01)
A61K 38/16 (2006.01)
C07K 16/46 (2006.01)

(52) U.S. Cl.
CPC ......... *C07K 16/2827* (2013.01); *A61K 38/16* (2013.01); *C07K 16/2818* (2013.01); *C07K 16/46* (2013.01); *C07K 2317/14* (2013.01); *C07K 2317/565* (2013.01); *C07K 2317/70* (2013.01); *C07K 2317/92* (2013.01)

(58) Field of Classification Search
None
See application file for complete search history.

(56) References Cited

U.S. PATENT DOCUMENTS

| 4,997,913 | A | 3/1991 | Hellstrom et al. |
|---|---|---|---|
| 5,827,817 | A | 10/1998 | Larsen et al. |
| 7,833,530 | B2 | 11/2010 | Alvarez et al. |
| 8,114,968 | B2 | 2/2012 | Devy et al. |
| 8,889,628 | B2 | 11/2014 | Shaw |
| 10,259,866 | B2 | 4/2019 | Nitsch et al. |
| 11,014,987 | B2 * | 5/2021 | Snyder ............... C07K 16/2818 |
| 2005/0260711 | A1 | 11/2005 | Datta et al. |
| 2010/0260765 | A1 | 10/2010 | Barry et al. |
| 2010/0330078 | A1 | 12/2010 | Bender et al. |
| 2011/0027278 | A1 | 2/2011 | Noelle et al. |
| 2011/0081666 | A1 | 4/2011 | Alvarez et al. |
| 2012/0100140 | A1 | 4/2012 | Reyes et al. |
| 2012/0108455 | A1 | 5/2012 | Kodandapani et al. |
| 2012/0148571 | A1 | 6/2012 | Lasters et al. |
| 2014/0105912 | A1 | 4/2014 | Noelle |
| 2014/0341920 | A1 | 11/2014 | Noelle et al. |
| 2014/0378660 | A1 | 12/2014 | Short et al. |
| 2015/0265703 | A1 | 9/2015 | Herting et al. |
| 2015/0337053 | A1 | 11/2015 | McCarthy et al. |

(Continued)

FOREIGN PATENT DOCUMENTS

| CN | 104968364 A | 10/2015 |
|---|---|---|
| CN | 105246507 A | 1/2016 |

(Continued)

OTHER PUBLICATIONS

Almagro & Fransson, Frontiers in Bioscience 2008; 13:1619-33 (Year: 2008).*
Rudikoff et al. (Proc Natl Acad Sci USA 1982 vol. 79 p. 1979). (Year: 1979).*
MacCallum et al. J. Mol. Biol. (1996) 262, 732-745 (Year: 1996).*
Pascalis et al. (The Journal of Immunology (2002) 169, 3076-3084) (Year: 2002).*

(Continued)

*Primary Examiner* — Meera Natarajan
(74) *Attorney, Agent, or Firm* — McNeill PLLC

(57) ABSTRACT

The present application relates to antibodies specifically binding to the V-domain immunoglobulin-containing suppressor of T-cell activation (VISTA) at acidic pH and their use in cancer treatment. In some embodiments, the antibodies bind specifically to human VISTA at acidic pH, but do not significantly bind to human VISTA at neutral or physiological pH.

28 Claims, 67 Drawing Sheets

Specification includes a Sequence Listing.

(56) References Cited

U.S. PATENT DOCUMENTS

| | | | |
|---|---|---|---|
| 2016/0096891 | A1 | 4/2016 | Chen et al. |
| 2016/0159927 | A1 | 6/2016 | Molloy et al. |
| 2016/0176963 | A1 | 6/2016 | Maurer et al. |
| 2016/0347814 | A1 | 12/2016 | Levine et al. |
| 2016/0347849 | A1 | 12/2016 | Cai et al. |
| 2017/0051061 | A1 | 2/2017 | Snyder et al. |
| 2017/0119877 | A1 | 5/2017 | Green et al. |
| 2017/0198052 | A1 | 7/2017 | Lin et al. |
| 2019/0330364 | A1 | 10/2019 | Johnston et al. |
| 2020/0055936 | A1 | 2/2020 | Johnston et al. |

FOREIGN PATENT DOCUMENTS

| | | |
|---|---|---|
| CN | 106414489 A | 2/2017 |
| CN | 110563843 A | 12/2019 |
| NO | 1997009068 A2 | 3/1997 |
| RU | 2550262 C1 | 5/2015 |
| TW | 201619195 A | 6/2016 |
| WO | 9201718 A2 | 2/1992 |
| WO | 9410309 A1 | 5/1994 |
| WO | 9411498 A1 | 5/1994 |
| WO | 9506118 A1 | 3/1995 |
| WO | 9530001 A2 | 11/1995 |
| WO | 9706176 A2 | 2/1997 |
| WO | 9808949 A1 | 3/1998 |
| WO | 9931117 A1 | 6/1999 |
| WO | 0000610 A2 | 1/2000 |
| WO | 2000012708 A2 | 3/2000 |
| WO | 2000078961 A1 | 12/2000 |
| WO | 0104297 A2 | 1/2001 |
| WO | 0173028 A2 | 10/2001 |
| WO | 2003105757 A2 | 12/2003 |
| WO | 2004022594 A2 | 3/2004 |
| WO | 2003013603 | 6/2004 |
| WO | 2005110475 A2 | 11/2005 |
| WO | 2005027831 A3 | 12/2005 |
| WO | 2006012232 A1 | 2/2006 |
| WO | 2006116181 A2 | 11/2006 |
| WO | 2007067984 A3 | 8/2007 |
| WO | 2007100211 A1 | 9/2007 |
| WO | 2007033959 A3 | 11/2007 |
| WO | 2009140623 A3 | 1/2010 |
| WO | 2010104821 A1 | 9/2010 |
| WO | 2011120013 A2 | 9/2011 |
| WO | 2005110456 | 2/2012 |
| WO | 2012033953 A1 | 3/2012 |
| WO | 2012174001 A1 | 12/2012 |
| WO | 2013082200 A1 | 6/2013 |
| WO | 2013134743 A1 | 9/2013 |
| WO | 2013192504 A1 | 12/2013 |
| WO | 2014039983 A1 | 3/2014 |
| WO | 2014089113 A1 | 6/2014 |
| WO | 2014190356 A2 | 11/2014 |
| WO | 2014197849 A2 | 12/2014 |
| WO | 2015069770 A1 | 5/2015 |
| WO | 2015097536 A2 | 7/2015 |
| WO | 2015109340 A2 | 7/2015 |
| WO | 2015187359 A1 | 12/2015 |
| WO | 2015191881 A2 | 12/2015 |
| WO | 2016007653 A2 | 1/2016 |
| WO | 2016090347 A1 | 6/2016 |
| WO | 2016094837 A2 | 6/2016 |
| WO | 2016207717 A1 | 12/2016 |
| WO | 2017078839 A1 | 5/2017 |
| WO | 2017120534 A1 | 7/2017 |
| WO | 2017137830 A1 | 8/2017 |
| WO | 2017175058 A1 | 10/2017 |
| WO | 2017181109 A1 | 10/2017 |
| WO | 2017181139 A2 | 10/2017 |
| WO | 2018027042 A1 | 2/2018 |
| WO | 2018047143 A1 | 3/2018 |
| WO | 2018132476 A1 | 7/2018 |
| WO | 2018169993 A1 | 9/2018 |
| WO | 2018195772 A1 | 11/2018 |
| WO | 2018237287 A1 | 12/2018 |
| WO | 2019078699 A2 | 4/2019 |
| WO | 2019087092 A1 | 5/2019 |
| WO | 2019165233 A1 | 8/2019 |
| WO | 2019183040 A1 | 9/2019 |
| WO | 2019185163 A1 | 10/2019 |
| WO | 2019185879 A1 | 10/2019 |
| WO | 2020014327 A2 | 1/2020 |

OTHER PUBLICATIONS

Casset et al. (BBRC 2003, 307:198-205) (Year: 2003).*
Vajdos et al. (J. Mol. Biol. (2002) 320, 415-428) (Year: 2002).*
Chen et al. (J. Mol. Bio. (1999) 293, 865-881) (Year: 1999).*
Wu et al. (J. Mol. Biol. (1999) 294, 151-162) (Year: 1999).*
Padlan et al. (PNAS 1989, 86:5938-5942) (Year: 1989).*
Lamminmaki et al. (JBC 2001, 276:36687-36694) (Year: 2001).*
Extended European Search Report received in European Patent Application No. 18738529.9 dated Jul. 3, 2020, 7 pages.
File History of U.S. Appl. No. 16/476,814, filed Jul. 9, 2019.
File History of U.S. Appl. No. 16/493,712, filed Sep. 12, 2019.
International Search Report and Written Opinion for PCT/US2019/041154, dated Jan. 24, 2020, 21 pages.
International Search Report for PCT/US2018/013171, dated May 14, 2018, 16 pages.
International Search Report for PCT/US2018/022230, dated May 31, 2018, 21 pages.
International Search Report for PCT/US2019/022895, dated Jul. 16, 2019, 14 pages.
Johnston et al., "Acidic pH Selective Binding of VISTA to PSGL-1 and Anti-Tumor Activity of Combined VISTA and PD-1 Blockade," Cancer Research, 2019, 70(13): supplement.
Johnston et al., "VISTA is an Acidic pH-Selective Ligand for PSGL-1," Nature, 2019, 574:565-588.
Le Mercier et al., "VISTA Regulates the Development of Protective Antitumor Immunity," Cancer Res., 2014, 74(7): 1933-1944.
Lenter et al., "Monospecific and Common Glycoprotein Ligands for E- and P-Selectin on Myeloid Cells," J. Cell Biol., 1994, 125(2):471-481.
Lines et al., "VISTA is a Novel Broad-Spectrum Negative Checkpoint Regulator for Cancer Immunotherapy," Cancer Immunol Res., 2014, 2(6):510-517.
Machine Translation of CN110563843A.
Machine Translation of WO 2019/078699, 41 pages.
Mahoney et al., "Acidity Changes Immunology: A New VISTA Pathway," Nature Immunology, 2020, 21:13-16.
Mangsbo et al., "The Human Agonistic CD40 Antibody ADC-1013 Eradicates Bladder Tumors and Generates T-cell-Dependent Tumor Immunity," Clin Cancer Res, 2015, 21(5):1115-26.
Matsumoto et al., "P-Selectin Glycoprotein Ligand-1 Negatively Regulates T-Cell Immune Responses," J Immunol, 2009, 183:7204-7211.
Wang et al., "VISTA, a novel mouse Ig superfamily ligand that negatively regulates T cell responses," J. Exp. Med., 2011, 208(3):577-592.
Zhao et al., "Oncogenic Pathways that Affect Antitumor Immune Response and Immune Checkpoint Blockade Therapy," Pharmacology & Therapeutics, 2018, 181:76-84.
Zhu et al., "B7-H5 costimulates human T cells via CD28H," Nature Comm, 2013, 4:1-12.
Tinoco et al., "PSGL-1 Is an Immune Checkpoint Regulator that Promotes T Cell Exhaustion," Immunity, 2016, 44:1190-1203.
File History of U.S. Appl. No. 17/761,458, filed Mar. 17, 2022, Inventors: Lin Hui Su et al.
International Search Report and Written Opinion for PCT/US2020/051421, dated Mar. 11, 2021, Applicant: Bristol-Myers Squibb Company, 30 pages.
Bostrom et al., "Improving Antibody Binding Affinity and Specificity for Therapeutic Development," Methods Mol. Biol., 2009, 525:353-376.
Brown et al., "Tolerance to Single, but Not Multiple, Amino Acid Replacements in Antibody Vh CDR2: A Means of Minimizing B

(56) References Cited

OTHER PUBLICATIONS

Cell Wastage from Somatic Hypermutation?," J Immunol, 1996, 156:3285-3291.

Gonzales et al., "Minimizing the Immunogenicity of Antibodies for Clinical Application," Tumour Biol, 2005, 26(1):31-43.

Kunik et al, "Structural Consensus among Antibodies Definse the Antigen Binding Site," PLoS Comput Biol, 2012, 8(2):e1002388, 12 pages.

Wark et al., "Latest Technologies for the Enhancement of Antibody Affinity," Adv Drug Delivery Rev, 2006, 58(5-6):657-670.

File History of U.S. Appl. No. 18/162,991, filed Feb. 1, 2023, Inventors: Robert J. Johnston et al.

File History of U.S. Appl. No. 17/258,866, filed Jan. 8, 2021.

Deng et al, "A New VISTA on combination therapy for negative checkpoint regulator blockade," J Immunotherapy Cancer, 2016, 4(1):1-7.

Krieg et al., "Functional Analysis of B and T Lymphocyte Attenuator engagement on CD4+ and CD8+ T Cells," J Immunology, 2005, 175(10):6420-6427.

Morris, "Epitope Mapping of Protein Antigens by Competition ELISA", The Protein Protocols Handbook, Totowa, NJ, Humana Press, 1996, pp. 595-600.

Supplementary Extended European Search Report received in European Patent Application No. 18767615.0 dated Apr. 29, 2021, 12 pages.

File History of U.S. Appl. No. 18/543,912, filed Dec. 18, 2023, Inventors: Robert J. Johnston et al.

GenBank AAA53000.1, immunoglobin heavy chain, partial, Jul. 26, 2016, 4 pages.

GenBank ABF83385.1, circulating B cell antibody heavy chain variable region, partial, Jul. 14, 2016, 4 pages.

Lobo et al., "Antibody Pharmacokinetics and Pharmacodynamics". J Pharm Sci., 2004; 93(11):2645-68.

Machine translation of RU2550262, May 10, 2015, Pigareva et al., 10 pages.

PIR: S23628, Ig kappa chain V region—human (fragment), Jan. 21, 2000, 2 pages.

Liu, "Pharmacokinetics of monoclonal antibodies and Fc-fusion proteins," Protein Cell, 2018, 9(1):15-32.

File History of U.S. Appl. No. 17/695,081, filed Mar. 15, 2022.

\* cited by examiner

Hu/Cy/Ms conserved histidines (bold, underlined)
Hu/Cy-conserved histidines (bold)

```
Human NP_071436.1     Sig- FKVATPYSLYVCPEGQNVTLTCRLLGPVDKGHDVTFYKTWYR
Cyno  XP_005565644.1  Sig- FKVATLYSLYVCPEGQNVTLTCRVFGPVDKGHDVTFYKTWYR
Mouse NP_083008.1     Sig- FKVTTPYSLYVCPEGQNATLTCRILGPVSKGHDVTIYKTWYL Human NP_071436.1     SSRGEVQTCSERRPIRNLTFQDLHLHHGGHQAANTSHDLAQRHGLES
Cyno  XP_005565644.1  SSRGEVQTCSERRPIRNLTFQDLHLHHGGHQAANTSHDLAQRHGLES
Mouse NP_083008.1     SSRGEVQMCKEHRPIRNFTLQHLQ-HHGSHLKANASHDQPQKHGLEL Human NP_071436.1     ASDHHGNFSITMRNLTLLDSGLYCCLVVEIRHHHSEHRVHGAMELQV
Cyno  XP_005565644.1  ASDHHGNFSITMRNLTLLDSGLYCCLVVEIRHHHSEHRVHGAMELQV
Mouse NP_083008.1     ASDHHGNFSITRNVTPRDSGLYCCLVIELKNHHPEQRFYGSMELQV Human NP_071436.1     QTGKDAPSNCVVYPSSSQDSENITAA -TMD
Cyno  XP_005565644.1  QTGKDAPSSCVAYPSSSQESENITAA -TMD
Mouse NP_083008.1     QAGKGSGSTCMA--SNEQDSDSITAA -TMD
```

FIG. 1B

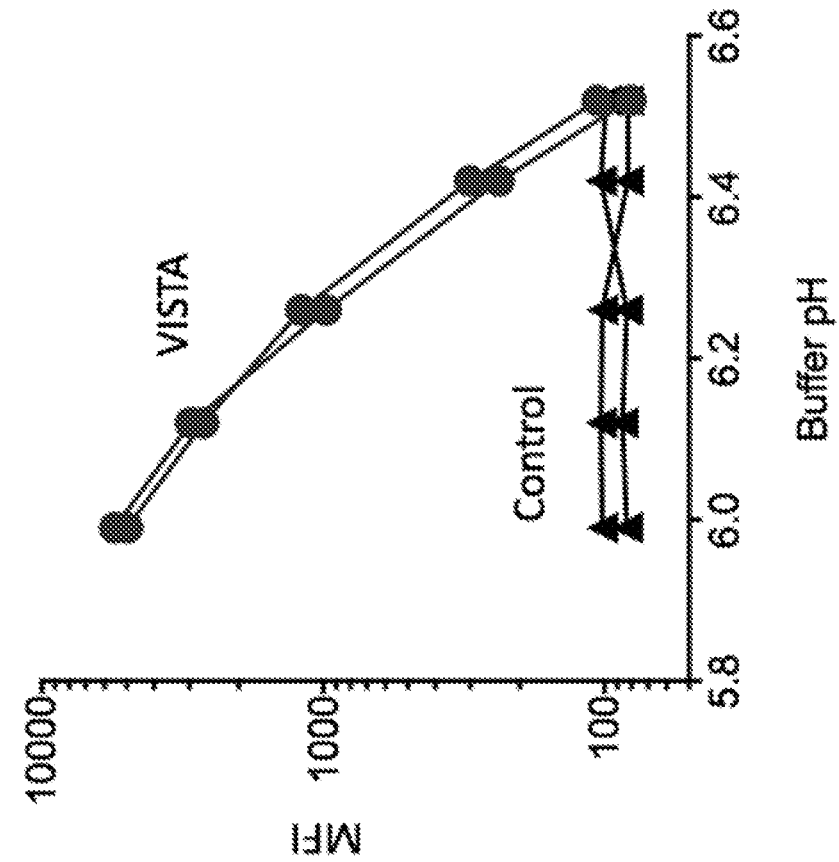
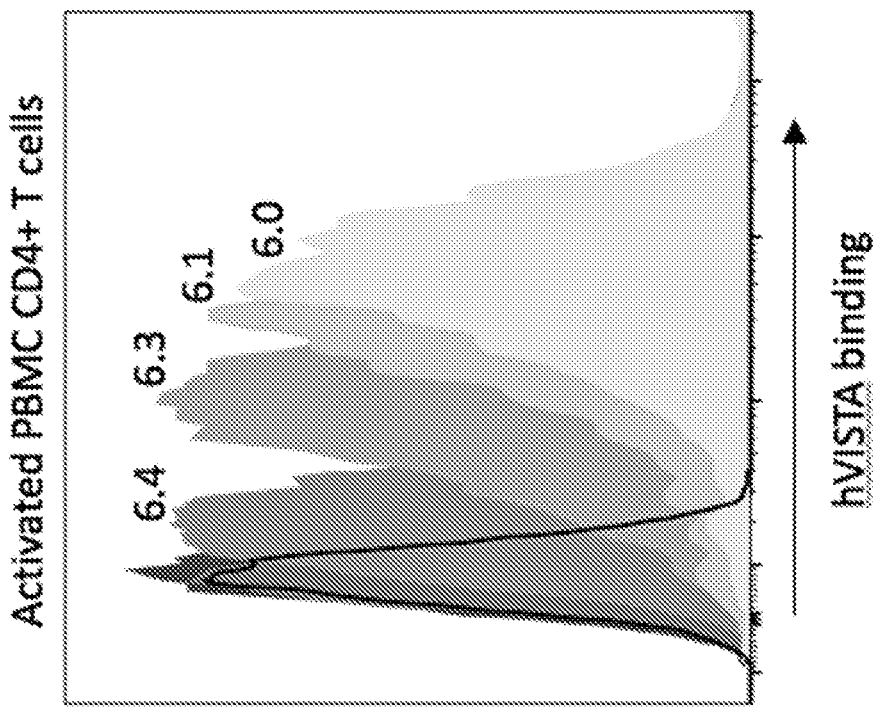
FIG. 4A

| Antibody | P1 ID | pH 7.4 | | | pH 6.7 | | | pH 6.0 | | | HCDR1 | HCDR2 | HCDR3 |
|---|---|---|---|---|---|---|---|---|---|---|---|---|---|
| | | kd (1/s) | KD (M) | hVISTA %Rmax | kd (1/s) | KD (M) | hVISTA %Rmax | kd (1/s) | KD (M) | hVISTA %Rmax | | | |
| P1-068761_E100fF | P1-070874 | 1.3E-03 | 2.0E-08 | 73.3 | 2.2E-04 | 1.3E-09 | 117.0 | 1.3E-04 | 1.9E-10 | 130.1 | .....E.E... | .....EE....... | .......H........E.. |
| P1-068761_E55A_E100fF | P1-070898 | 1.7E-03 | 1.4E-08 | 82.3 | 2.8E-04 | 1.5E-09 | 119.8 | 1.8E-04 | 2.6E-10 | 133.7 | .....E.E... | ......E....... | .......H........E.. |
| P1-068761_H100G_E100fF | P1-070880 | 2.3E-03 | 4.1E-08 | 61.8 | 4.0E-04 | 2.3E-09 | 116.7 | 2.1E-04 | 2.3E-10 | 126.7 | .....E.E... | ......EE...... | ................E.. |
| P1-068761_E30D_E100fF | P1-070896 | 3.5E-03 | 4.8E-08 | 65.2 | 5.7E-04 | 3.7E-09 | 112.6 | 3.3E-04 | 4.3E-10 | 130.4 | ...E.E.E... | ......E....... | .......H........E.. |
| P1-068761_E56N_E100fF | P1-070902 | 3.0E-03 | 6.5E-08 | 47.4 | 6.1E-04 | 6.5E-09 | 85.9 | 3.8E-04 | 1.4E-09 | 116.5 | .....E.E... | ......EE...... | ................E.. |
| P1-068761_E32Y | P1-070866 | 2.5E-03 | 1.8E-08 | 102.5 | 6.4E-04 | 1.6E-09 | 120.9 | 4.1E-04 | 2.1E-10 | 123.1 | .......E... | ......EE...... | .......H........... |
| P1-068761_E32Y_E55A | P1-070882 | 2.7E-03 | 2.3E-08 | 89.3 | 6.0E-04 | 2.0E-09 | 116.3 | 5.7E-04 | 3.1E-10 | 117.6 | .......E... | ......E....... | .......H........... |
| P1-068761_E32Y_E56N | P1-070884 | 3.2E-03 | 4.2E-08 | 73.7 | 8.3E-04 | 5.1E-09 | 104.4 | 7.0E-04 | 1.2E-10 | 115.8 | .......E... | ......EE...... | .......H........... |
| P1-068761_E32Y_E30D | P1-070876 | 3.5E-03 | 2.1E-08 | 110.8 | 9.9E-04 | 2.0E-09 | 124.0 | 7.1E-04 | 2.4E-10 | 124.9 | ...E.E.E... | ......E....... | .......H........... |
| P1-068761_E32Y_H100G | P1-070886 | 5.5E-03 | 7.2E-08 | 68.0 | 1.3E-03 | 5.0E-09 | 113.4 | 9.2E-04 | 4.8E-10 | 120.4 | .......E... | ......EE...... | ................... |
| P1-068761_E32Y_E100fF | P1-070888 | 1.9E-03 | 3.7E-09 | 132.1 | 9.5E-04 | 1.1E-09 | 125.0 | 1.1E-03 | 2.5E-10 | 120.8 | .......E... | ......EE...... | .......H........E.. |
| P1-068761 | P1-068761 | NB | NB | 0.7 | 6.6E-03 | 7.1E-08 | 49.7 | 1.4E-03 | 2.6E-09 | 122.5 | ........... | .............. | ................... |
| P1-068761_E55A | P1-070868 | NB | NB | 2.8 | 6.4E-03 | 1.2E-07 | 42.2 | 1.7E-03 | 3.4E-09 | 113.1 | ........... | ......E....... | ................... |
| P1-068761_H100G | P1-070872 | NB | NB | 2.9 | 1.4E-02 | 2.3E-07 | 36.1 | 5.2E-03 | 4.4E-09 | 121.0 | ........... | .............. | ................... |
| P1-068761_E56N | P1-070870 | NB | NB | 1.7 | >1E-02 | ~8.2E-06 | 17.6 | 5.5E-03 | 1.9E-08 | 86.3 | ........... | ......EE...... | ................... |
| P1-068761_E55A_E56N | P1-070878 | NB | NB | 0.9 | 2.9E-02 | 2.1E-07 | 16.4 | 5.6E-03 | 2.1E-08 | 79.3 | ........... | ......EE...... | ................... |
| P1-068761_E55A_E30D | P1-070864 | NB | NB | 0.4 | 1.8E-02 | 3.7E-07 | 25.6 | 6.2E-03 | 8.3E-09 | 109.9 | ...E.E.E... | ......E....... | ................... |
| P1-068761_E30D_E55A | P1-070890 | NB | NB | 1.8 | >1E-02 | ~1.1E-07 | 22.1 | 7.4E-03 | 1.2E-08 | 99.1 | ...E.E.E... | ......E....... | ................... |
| P1-061029 | P1-061029 | 7.5E-03 | 3.2E-08 | 93.4 | 4.4E-03 | 1.1E-08 | 96.9 | 8.2E-03 | 4.5E-09 | 98.5 | GFTLDDYAMH | GINWNSANIGYADSVKG | VPGYSGGWIDAFDV |
| P1-068761_E56N_H100G | P1-070900 | NB | NB | 4.4 | NB | NB | 19.4 | 8.1E-03 | 1.0E-08 | 110.9 | ........... | ......EE...... | ................... |
| P1-068761_E30D_H100G | P1-070894 | NB | NB | 3.1 | >1E-02 | ~8.1E-08 | 14.6 | 2.1E-02 | 1.5E-08 | 91.9 | ...E.E.E... | ......E....... | ................... |
| P1-068761_E30D_E56N | P1-070892 | NB | NB | 0.4 | >1E-02 | ~3.2E-08 | 8.3 | 3.4E-02 | 5.0E-08 | 56.3 | ...E.E.E... | ......EE...... | ................... |

FIG. 10A

| Antibody | P1 ID | pH 7.4 | | | pH 6.7 | | | pH 6.0 | | | HCDR1 | HCDR2 | HCDR3 |
|---|---|---|---|---|---|---|---|---|---|---|---|---|---|
| | | kd (1/s) | KD (M) | hVISTA %Rmax | kd (1/s) | KD (M) | hVISTA %Rmax | kd (1/s) | KD (M) | hVISTA %Rmax | | | |
| P1-068767_D52N_D102V | P1-070930 | 6.7E-03 | 8.7E-08 | 60.0 | 1.8E-03 | 7.5E-09 | 101.0 | 1.2E-03 | 8.8E-10 | 114.6 | .....E..... | ......E..... | .........E... |
| P1-068767_D52N | P1-070906 | NB | NB | 3.9 | 6.7E-03 | 2.1E-07 | 38.9 | 1.5E-03 | 3.2E-09 | 116.6 | .....E..... | ......E..... | .........E.D |
| P1-068767_D52N_E55A | P1-070916 | NB | NB | 2.3 | 5.5E-03 | 1.2E-07 | 33.7 | 1.5E-03 | 4.0E-09 | 112.0 | .....E..... | ......E..... | .........E.D |
| P1-068767_E55A_D102V | P1-070932 | 1.0E-02 | 2.8E-07 | 35.4 | 3.1E-03 | 1.5E-08 | 85.7 | 2.0E-03 | 1.9E-09 | 111.3 | .....E..... | ......D..... | .........E... |
| P1-068767_D102V | P1-070912 | 9.2E-03 | 1.7E-07 | 44.7 | 2.8E-03 | 1.4E-08 | 98.5 | 2.0E-03 | 1.3E-09 | 111.9 | .....E..... | ......D..... | .........E.D |
| P1-068767_E55A | P1-070908 | NB | NB | 2.8 | 8.5E-03 | 3.8E-07 | 26.8 | 2.3E-03 | 5.7E-09 | 108.0 | .....E..... | ......D..... | .........E... |
| P1-068767_E30D_D52N | P1-070914 | NB | NB | 4.5 | 1.1E-02 | 1.2E-07 | 35.8 | 2.3E-03 | 5.8E-09 | 105.7 | .....E..... | ......E..... | .........E.D |
| P1-068767 | P1-068767 | NB | NB | 1.9 | 7.2E-03 | 1.8E-07 | 31.1 | 2.4E-03 | 5.2E-09 | 111.7 | .....E..... | ......E..... | .........E... |
| P1-068767_E30D_D102V | P1-070926 | 1.1E-02 | 2.2E-07 | 40.8 | 3.5E-03 | 1.7E-08 | 95.7 | 3.0E-03 | 2.1E-09 | 114.8 | .....E..... | ......D..... | .........E.D |
| P1-068767_E30D | P1-070904 | NB | NB | 5.8 | NB | NB | 21.0 | 3.2E-03 | 9.6E-09 | 99.8 | .....E..... | ......D..... | .........E.D |
| P1-068767_E30D_E55A | P1-070922 | NB | NB | 3.5 | NB | NB | 22.6 | 3.5E-03 | 8.3E-09 | 108.8 | .....E..... | ......D..... | .........E.D |
| P1-061029 | P1-061029 | 7.5E-03 | 3.2E-08 | 93.4 | 4.4E-03 | 1.1E-08 | 96.9 | 8.2E-03 | 4.5E-09 | 98.5 | GFTLDDYAMH | GINWNSANIGYADSVKG | VPGYSGGWIDAFDV |
| P1-068767_E100fF_D102V | P1-070920 | 8.3E-03 | 4.1E-08 | 86.8 | 4.7E-03 | 1.1E-08 | 103.4 | 8.2E-03 | 2.7E-09 | 103.4 | .....E..... | ......D..... | .........D |
| P1-068767_E55A_E100fF | P1-070918 | NB | NB | 1.8 | NB | NB | 8.6 | 1.3E-02 | 6.2E-08 | 42.5 | .....E..... | ......D..... | .........D |
| P1-068767_D52N_E100fF | P1-070928 | NB | NB | 9.4 | >1E-02 | ~3.9E-08 | 22.7 | 6.6E-02 | 2.0E-08 | 64.0 | .....E..... | ......D..... | .........D |
| P1-068767_E100fF | P1-070910 | NB | NB | 1.8 | 2.6E-02 | 5.2E-06 | 9.6 | >1E-02 | ~4.2E-08 | 49.4 | .....E..... | ......D..... | .........D |
| P1-068767_E30D_E100fF | P1-070924 | NB | NB | 1.0 | 2.7E-02 | 1.0E-05 | 7.0 | >1E-02 | ~8.2E-08 | 32.9 | .....E..... | ......D..... | .........D |

FIG. 10B

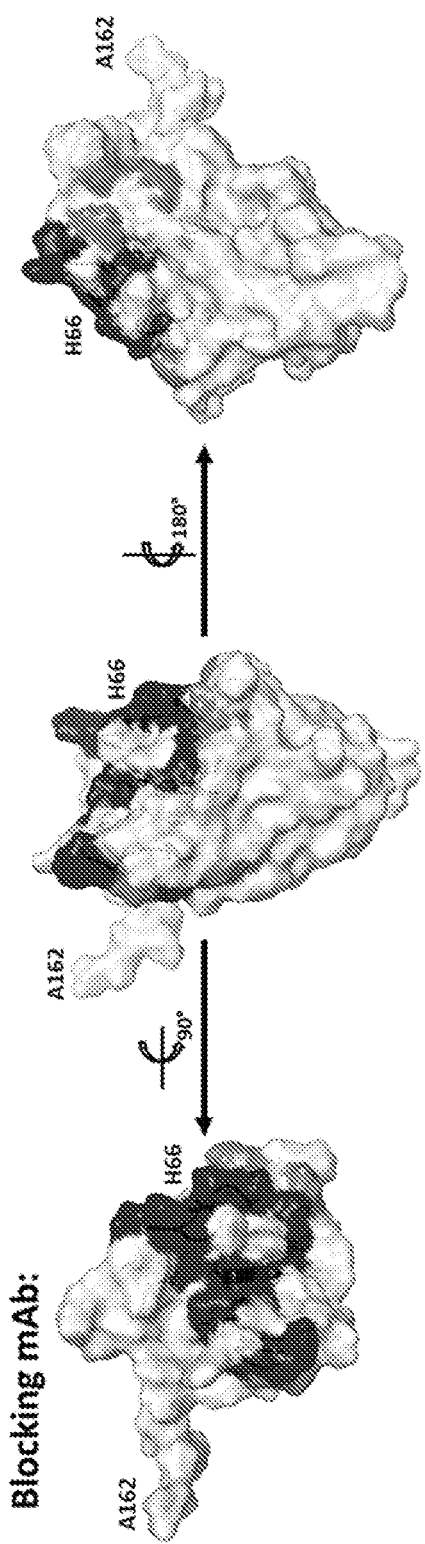
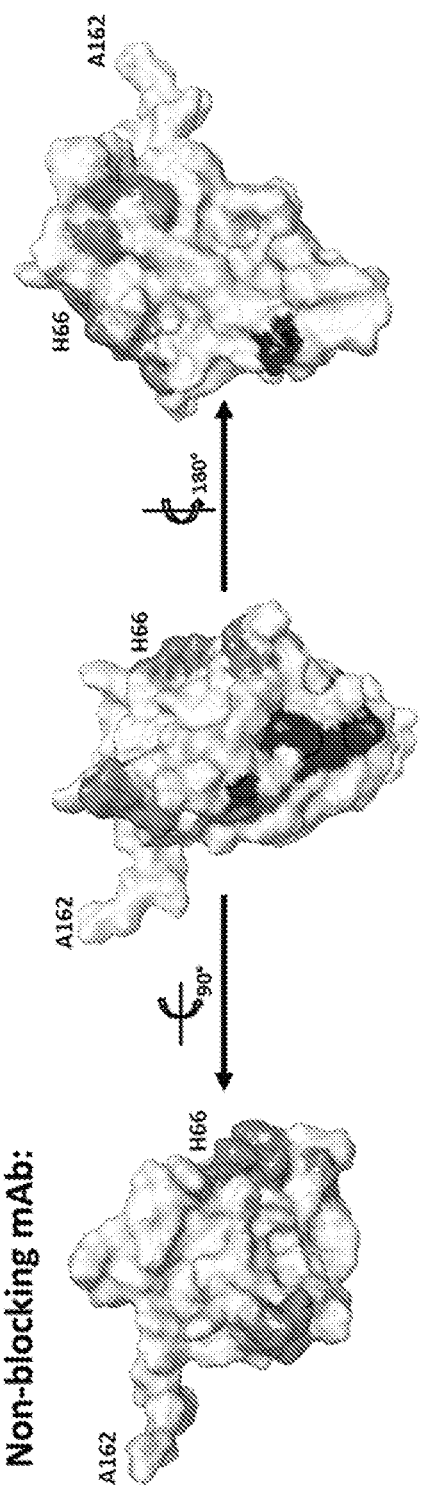
FIG. 11B
FIG. 11C

FIG. 13A (cont.)

```
            10        20        30        40        50        60        70        80        90       100       110       120
            |         |         |         |         |         |         |         |         |         |         |         |
P1-061015   QVQLVESGGGVVQPGRSLRLSCAASGFTFSSYAMHWVRQAPGKGLEWVAIIWYDGSNKYYADSVKGRFTISRDNSKNTLYLQMNSLRAEDTAVYYCARDSGFYSSYYFDYWGQGTLVTVSS
P1-068736   ...........................E.H..................D..D..........................................D..D.................
P1-068738   ...........................E.H....................H.........................................ED..D.................
P1-068740   ...........................D......................D.D.........................................ED..D.................
P1-068742   ...........................D......................D.D.........................................ED..................
P1-068744   ...........................E...................H......E...................................E...E...................
P1-068746   ...........................HH.....................HH..............................................D..................
P1-068748   ..........................D.D.....................DD..............................................D..................
P1-068750   ...........................................E.D....D........................................EE...E...................
P1-068752   ...........................................E..D...D..............................................D..E.................
P1-068754   .........................D.D................E.D...................................................H.D................

FIG. 13B
```

761                         EVQLVESGGGLVQPGKSLRLSCAASGFTLEDEAMHWVRQAPGKGLEWVSGINWNSEEIGYADSVKGRFTISRDNAKNSLY
P1-068761_VH_K16R_T84A  EVQLVESGGGLVQPGRSLRLSCAASGFTLEDEAMHWVRQAPGKGLEWVSGINWNSEEIGYADSVKGRFTISRDNAKNSLY

Column #                            10        20        30        40        50        60        70        80

761                         LQMNSLRTEDTALYYCAKVPGYSHGWIDAEDVWGQGTMVTVSS    (SEQ ID NO: 51)
P1-068761_VH_K16R_T84A  LQMNSLRAEDTALYYCAKVPGYSHGWIDAEDVWGQGTMVTVSS    (SEQ ID NO: 463)

Column #                            90        100       110       120

FIG. 14

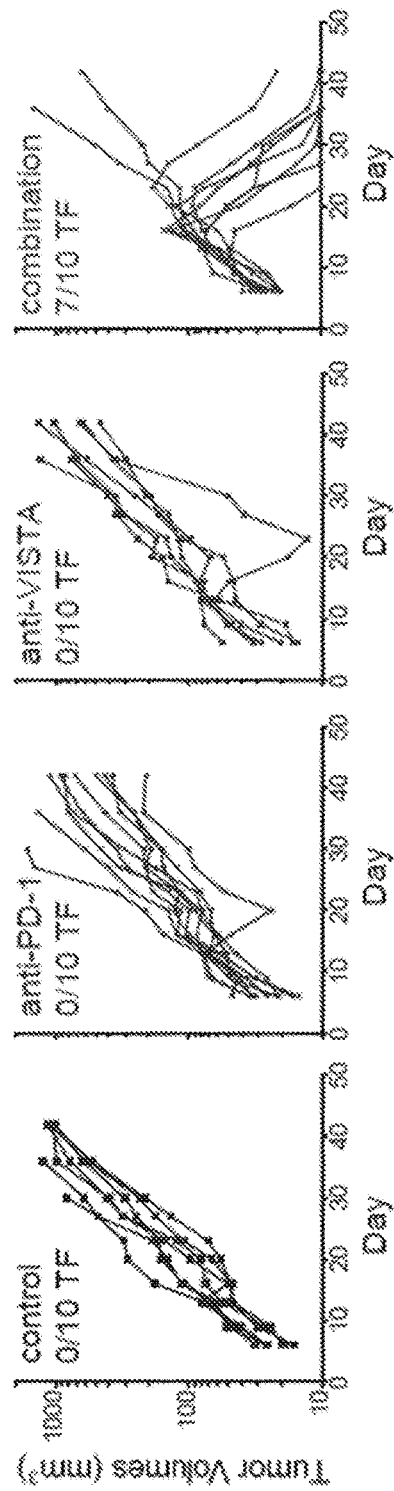
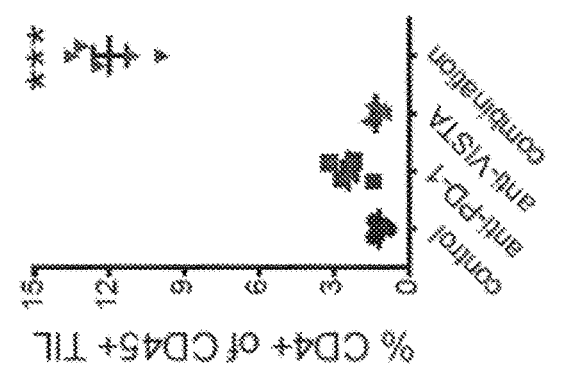
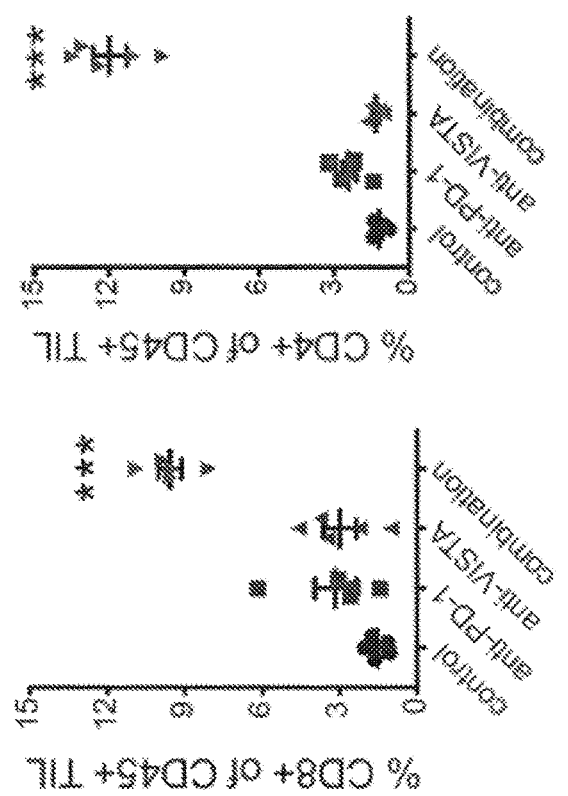

```
        10          20          30          40          50
MGVPTALEAG  SWRWGSLLFA  LFLAASLGPV  AAFKVATPYS  LYVCPEGQNV
        60          70          80          90         100
TLTCRLLGPV  DKGHDVTFYK  TWYRSSRGEV  QTCSERRPIR  NLTFQDLHLH
       110         120         130         140         150
HGGHQAANTS  HDLAQRHGLE  SASDHHGNFS  ITMRNLTLLD  SGLYCCLVVE
       160         170         180         190         200
IRHHSEHRV  HGAMELQVQT  GKDAPSNCVV  YPSSSQDSEN  ITAAALATGA
```

ANTIBODIES BINDING TO VISTA AT ACIDIC pH

This application is a national stage application of International Patent Application No. PCT/US2019/022895, filed Mar. 19, 2019, which claims priority to U.S. Provisional Application Nos. 62/733,462, filed Sep. 19, 2018, 62/696,597, filed Jul. 11, 2018, and 62/646,344, filed Mar. 21, 2018, each of which is incorporated in their entirety by reference herein.

FIELD

The present application relates to antibodies specifically binding to the V-domain immunoglobulin-containing suppressor of T-cell activation (VISTA) at acidic pH and their use in cancer treatment.

SEQUENCE LISTING

The present application is filed with a Sequence Listing in electronic format. The Sequence Listing is provided as a file entitled "2019-06-03_01134-0059-OOPCT_ST25.txt" created on Jun. 3, 2019, which is 853 KB in size. The information in the electronic format of the sequence listing is incorporated herein by reference in its entirety.

BACKGROUND AND SUMMARY OF THE DISCLOSURE

The V-domain Ig-containing suppressor of T-cell activation, or VISTA, is a co-inhibitory member of the B7 family of immunoreceptors expressed by myelomonocytic cells and other leukocytes. However, the mechanism by which VISTA suppresses immune responses is poorly understood.

The inventors have found that unlike other known immunoreceptors, VISTA engages its counter-receptors and functions selectively at acidic pH, with little activity at physiological pH (e.g., 7.3-7.4). VISTA may thus suppress immune responses in acidic microenvironments, such as tumor beds or sites of inflammation, without perturbing cells circulating in blood or residing in non-inflamed, non-acidic tissues. Additionally, the inventors have found that anti-VISTA antibodies can be engineered to selectively bind to VISTA at acidic pH, with little or no binding at physiological pH, mirroring VISTA's own acidic pH selectivity. These acidic pH selective antibodies may offer desirable properties for treating diseases, such as cancer, relative to antibodies that bind VISTA at physiological pH.

The present disclosure concerns antibodies that specifically bind to the extracellular domain (ECD) of VISTA, such as human VISTA ("hVISTA" or "huVISTA") at acidic pH (e.g., in acidic conditions). The present disclosure also concerns antibodies that specifically bind to the extracellular domain (ECD) of VISTA, such as hVISTA, at acidic pH, with little or no binding at neutral or physiological pH. The inventors have noted herein that the hVISTA-ECD amino acid sequence includes a number of conserved as well as nonconserved histidine residues, and that the frequency of histidine residues in VISTA's ECD is exceptionally high relative to other B7 family members and other Immunoglobulin Superfamily members. (See FIGS. 1A and 1B.) In solution, the amino acid histidine has a $pK_a$ of about 6.5, meaning that at or below pH 6.5, histidine residues within proteins are often protonated and thus, positively charged, while at pH higher than pH 6.5 they are increasingly unprotonated and neutral in charge. Tumor microenvironments and inflamed tissues are often acidic, and thus, VISTA proteins found in these microenvironments may be at least partially protonated at their histidine residues. The inventors, as discussed herein, have hypothesized that histidine protonation may affect the conformation, surface structure, and/or charge density of VISTA, which, in turn, may create pH-specific or pH-selective epitopes for both receptor-ligand interaction(s) and antibody binding. Targeting VISTA with antibodies that bind at acidic pH but not neutral or physiological pH may prevent target-mediated drug disposition via circulating and lymphoid organ-resident myelomonocytic cells, improving antibody PK, receptor occupancy, and activity in tumor microenvironments. Acidic pH-selective antibodies may also improve the specificity of VISTA antibodies for intratumoral, rather than circulating, target cells in the cases of therapeutic modalities such as antibody-dependent cell-mediated cytotoxicity (ADCC), antibody-dependent cellular phagocytosis (ADCP), complement-dependent cytotoxicity (CDC), and delivery of payloads (antibody-drug conjugates).

BRIEF DESCRIPTION OF THE FIGURES

The priority US provisional applications to which this application claims benefit contain at least one drawing executed in color. Should the provisional applications later become available to the public, copies of the color drawings should be made available from the United States Patent and Trademark Office upon request and payment of the necessary fee.

FIGS. 1A-C show that VISTA's extracellular domain contains an exceptionally high frequency of histidine residues, that many of these histidine residues are conserved, and that at least some of these histidine residues may participate in receptor-ligand binding. FIG. 1A shows a graph of immunoglobulin domain-containing proteins, with the number of extracellular domain amino acid residues for each protein plotted on the x-axis, and the frequency of histidine residues within the extracellular domain for each protein plotted on the y-axis. The size of each data point corresponds to the total number of histidine residues in each protein's extracellular domain. FIG. 1B shows the aligned amino acid sequences of the extracellular domains of human, cynomolgus macaque, and mouse VISTA. Signal peptide (Sig) and transmembrane domain (TMD) sequence locations are marked. Histidine residues conserved across all three species are shown in bold and underlined; histidine residues conserved across human and cynomolgus macaque are shown in bold only. FIG. 1C shows a model of the human VISTA immunoglobulindomain's three-dimensional structure. Histidine residues are depicted as ball and stick traces.

FIG. 2A shows the equilibrium between the lack of, and the presence of, protonation of the pyrrole ammonium group (NH) in a histidine residue. The $pK_a$ of histidine in solution is 6.5, indicating that histidine residues are more likely to be protonated at pH 6.5 and lower, and thus, positively charged, than at higher pH. FIG. 2B shows shows a model in which VISTA engages P-selectin glycoprotein ligand 1 (PSGL-1) or other counter-receptors and ligands ("VISTA-R") selectively at acidic pH. Accordingly, antibody binding to VISTA's extracellular domain at acidic pH rather than at physiological pH may be critical to inhibiting or modulating VISTA activity.

FIGS. 4A-G show that VISTA selectively binds to leukocytes and to PSGL-1 at acidic pH, with little or no binding at neutral pH, and that this binding can be blocked by an anti-VISTA antibody. FIG. 4A on the left shows representative histograms of fluorescently-conjugated recombinant VISTA multimer binding to activated human CD4+ T cells. From darker gray to lighter, the filled histograms depict binding at pH 7.0, 6.5, 6.4, 6.3, 6.1, and 6.0. Some histograms are labeled with their corresponding pH. Non-VISTA control multimer binding at pH 6.0 is shown as the unfilled histogram. On the right, the mean MFI of VISTA (circles) and control (triangles) multimer binding to activated human CD4+ T cells from two donors at different pH is graphed. FIG. 4B shows representative histograms of recombinant VISTA multimer binding to peripheral blood mononuclear cells (PBMC) at pH 6.0 and pH 7.4. From darker gray to lighter, the filled histograms depict binding at pH 6.0 to CD19+ B cells, CD4+ T cells, CD8+ T cells, CD56+ NK cells, and CD14+ monocytes. The unfilled, solid border and dotted border histograms depict binding at pH 7.4 to total PBMC lymphocytes and monocytes respectively. FIG. 4C shows representative recombinant VISTA multimer binding to activated human CD4+ T cells in the presence of an anti-VISTA blocking antibody (squares) or a non-VISTA-specific isotype-matched control antibody (circles). Antibody concentrations are plotted on log scale. Non-linear regressions are also shown. The triangle depicts the background signal from activated human CD4+ T cells that were not stained with recombinant VISTA multimers. FIG. 4D shows representative two-dimensional flow cytometry plots of recombinant VISTA multimer binding at pH 6.0 to heparan sulfate-deficient Chinese Hamster Ovary (CHO) cells (line pGSD-677, American Type Culture Collection) that were transfected to express human PSGL-1. Multimer binding was performed in the presence and absence of the anti-VISTA blocking antibody shown in FIG. 4C. Cells left unstained by recombinant VISTA multimers are shown as a control. PSGL-1 antibody staining is plotted on the y-axis, and VISTA multimer staining is plotted on the x-axis. FIG. 4E shows representative histograms of recombinant mouse VISTA-Fc fusion protein binding to mouse splenocytes at pH 6.0 and pH 7.4. From darker gray to lighter, the filled histograms depict binding at pH 6.0 to CD8+ T cells, CD11b+ myeloid cells, and CD4+ T cells. The unfilled histogram depicts binding at pH 7.4 to total splenocytes. FIGS. 4F and G show that VISTA multimer binds to monocytes and neutrophils, respectively, and does so more strongly at pH 6.0 then at pH 7.4.

FIG. 5A shows representative cell: cell conjugate formation at pH 6.0 and 7.0 between 293T cells expressing hVISTA or vector control (plotted on the y-axes) and CHO cells endogenously expressing cell surface heparan sulfate on the x-axes. FIG. 5B is a graph of the frequency of cell conjugates formed at pH 6.0 between the same cells in the presence of an anti-VISTA blocking antibody, an anti-VISTA non-blocking antibody, or isotype-matched non-VISTA-specific control antibodies. FIG. 5C shows representative plots of the luciferase activity generated by Jurkat (human T cell line) cells expressing an NFkB luciferase reporter after co-culture at various pH with 293T cells expressing h VISTA and a single-chain variable fragment of the anti-human T cell receptor agonist antibody OKT3 ("artificial antigen-presenting cells"). An anti-VISTA blocking antibody (squares) or an isotype-matched non-VISTA-specific control antibody (circles) were added to the co-cultured cells. In FIG. 5D, the data shown in FIG. 5A are plotted as fold-increase of the luciferase signal with anti-VISTA antibody treatment relative to control ("effect size").

FIG. 6A shows co-localization of VISTA, Rab5 (early endosome marker), Rab7 (late endosome marker), and Rab11 (recycling endosome marker) within 293T cells expressing human VISTA. FIG. 6B shows co-localization of VISTA and Rab11 within human monocytes. Intracellular VISTA is co-localized with Rab11+ recycling endosomes. A non-VISTA-binding control antibody of the same isotype as the VISTA antibody ("cAb") does not detectably bind the monocytes. FIG. 6C shows the binding of three anti-VISTA antibodies to recombinant VISTA at pH 7.4 (black), 6.7 (darker gray), and 6. (lighter gray). FIG. 6D shows the susceptibility of a VISTA expressing acute myeloid leukemia (AML) cell line to killing by the same anti-VISTA antibodies 1 (inverted triangles), 2 (circles), 3 (squares), or a non-VISTA-specific control antibody (triangles) bearing cathepsin B-sensitive linkers and cytotoxic payloads. Cell viability (CellTiter-Glo LU) is plotted on the y-axis and antibody concentrations are plotted on the x-axis. FIG. 6E compares hVISTA binding of anti-VISTA antibody 3 to that of an engineered variant ("VISTA mAb 3c") that does not exhibit impaired binding at acidic pH. FIG. 6F shows an antibody drug-conjugate assay comparing the potency of anti-VISTA antibody 3 (squares) and 3c (diamonds). FIG. 6G shows a schematic of endosome trafficking, with VISTA recycling to and from and cell surface via early endosomes and recycling endosomes.

FIG. 7A shows amino acid substitutions that were made in VH CDR 3 of the anti-human VISTA antibody clone P1-061029 (abbreviated '029) for creating an '029 library for screening. To potentially improve binding to VISTA's histidine-rich region at acidic pH, the libraries allowed substitutions for the negatively charged amino acids aspartate and glutamate as well as pH-responsive histidine. X=H, D or E. Bracketed sequences were removed from synthesis to avoid introducing liabilities. A total of 647 unique sequences of P1-061029 HCDR3 with 1-2 mutations were synthesized. FIG. 7B shows the procedure by which the '029 library is iteratively screened and selected for acidic pH-selective antibody variants. R denotes selection round. FIG. 7C shows representative two-dimensional flow cytometry plots data showing the variant pool after 9 rounds of selection. VISTA binding is plotted on the y-axis, and variant antibody expression is plotted on the x-axis. Binding data at various antibody concentrations and pH are shown. FIG. 7D shows a diagram of P1-061029 and its progeny clones binding to human VISTA at pH 6.0 and 7.4. FIG. 7E shows a diagram of the off-rates of P1-061029 and its progeny clones to human VISTA at pH 6.0. FIG. 7F shows SPR binding data of the antibodies P1-068761, P1-068767 and P1-061029 to human VISTA at pH 6.0 and pH 7.4.

FIG. 8A and FIG. 8B show the mean fluorescence intensity of the acidic pH-selective antibodies P1-068761 (FIG. 8A) and P1-068767 (FIG. 8B) binding to Raji cells ectopically expressing human VISTA. The cells were stained at approximately pH 6.0 (circles; highest curve in FIG. 8A), 6.1 (squares; third highest curve), 6.2 (triangles; second highest curve), 6.4 (inverted triangles; fourth highest curve close to the pH 6.1 curve), 6.6 (diamonds; fourth curve from bottom), 7.0 (circles; third curve from bottom), 7.2 (squares; second curve from bottom), and 8.1 (unfilled triangles; bottom curve in FIG. 8A). Binding was detected with a fluorescently conjugated anti-human IgG secondary antibody. FIG. 8C shows P1-068767 (circles) and an isotype-matched non-specific control antibody (triangles) binding to Raji cells ectopically expressing human VISTA at 3125 ng/mL at various pH. The "$pH_{50}$", the pH at which 50% of P1-068767 binding is lost, is approximately 6.6. FIG. 8D shows the mean fluorescence intensities (MFI) of an isotype-matched non-specific control antibody (filled and unfilled circles for pH 7.0 and 6.0 respectively), anti-VISTA mAb 2 ("control", see FIG. 6C, filled and unfilled squares at pH 7.0 and 6.0 respectively), P1-068761 (filled and unfilled triangles for pH 7.0 and 6.0 respectively), and P1-068767 (filled and unfilled inverted triangles for pH 7.0 and 6.0 respectively) binding to human monocytes. Binding was detected by a fluorescently conjugated anti-human IgG secondary antibody. FIG. 8E shows the comparable blocking of recombinant VISTA multimer binding to activated human CD4+ T cells at pH 6.0 by P1-061029 (squares), P1-068761 (triangles), and P1-068767 (inverted triangles), while a non-VISTA-specific control antibody (circles) did not block VISTA binding. FIG. 8F shows the reduced potency of P1-068761 (triangles) and P1-068767 (inverted triangles) in mediating antibody-dependent cell cytotoxicity (ADCC) at physiological pH. P1-061029 (squares), a non-VISTA-specific positive control antibody (circles), and a non-VISTA-specific negative control antibody (diamonds) are also shown. NK cell specific lysis of target cells as a percentage of total target cells is plotted on the y-axis and antibody concentrations are plotted on the x-axis. Non-linear regressions are also shown.

FIGS. 10A and 10B show the binding effects of mutations in the acidic pH-selective anti-VISTA antibodies '761 and '767. FIG. 10A shows kinetic binding data of P1-068761 reversion mutants at pH 7.4, pH 6.7 and pH 6.0 and the location of their reversion mutations relative to P1-068761. FIG. 10B shows kinetic binding data of P1-068767 reversion mutants at pH 7.4, pH 6.7 and pH 6.0 and the location of their reversion mutations relative to P1-068767.

FIGS. 11A-C show epitope binning and mapping of various anti-VISTA antibodies. FIG. 11A shows the VISTA epitope competition for P1-068761 and P1-068767 compared to P1-061029 and VISTA antibody controls. FIG. 11B and FIG. 11C show representations of the epitopes of all the residues for blocking hVISTA antibody (FIG. 11B) as listed in Table 14 compared to a non-blocking hVISTA antibody (mAb1; FIG. 11C). Amino acid residues 66(H) and 162(A) are indicated to denote the orientation of the molecule. Histidine residues are in grey, and epitope residues are in black.

FIG. 12A: P1-061029, FIG. 12B: P1-068761, and FIG. 12C: P1-068767. The isoelectric point of the main species (pI main) as well as pI markers are indicated.

FIG. 13A shows the alignment of the amino acid sequences of the variable regions of '029 and its progeny clones. FIG. 13B shows the alignment of the amino acid sequences of the variable regions of '015 and its progeny clones.

FIG. 14 shows an alignment of VH sequences of P1-068761 with and without K16R and T84A substitutions. The double-underlined residues show positions 16 and 84 of the framework regions and the shaded portions show the CDRs.

FIGS. 15A-O: Wildtype C57BL6 mice were implanted with MC38 tumors and treated with non-binding isotype-matched control antibodies (black squares), mouse VISTA blocking antibody VISTA.10 (upward triangles), a mouse PD-1 blocking antibody (squares), or a combination of VISTA and PD-1 blocking antibodies (downward triangles). All antibodies were mouse IgG1-D265A (Fc-inert) isotype. (See FIGS. 15A-D.) These data are representative of three independent experiments. FIGS. 15A-D show the tumor volumes over time. n=10 per group. "TF" denotes mice that rejected their tumors. FIGS. 15E and F show the frequency of intratumoral CD8+ T cells and CD4+ T cells 7 days after the start of treatment. n=5 per group. One-way ANOVA with Dunnett's multiple comparisons, P=0.0001. FIG. 15O shows Cynomolgus macaque serum antibody concentrations after intravenous injection of 5 mg/kg of VISTA.4 (circles) or P1-068767 (squares). The calculated serum mean residence times (MRT) for VISTA.4 and P1-061029 are estimated to be 7.6 hours and 717 hours respectively. n=1 macaque per antibody. These data are representative of a single experiment. Error bars depict the standard error of the mean where not otherwise indicated.

FIG. 17A shows BLI binding sensorgrams for P-Selectin-Fc and VISTA-Fc binding to captured PSGL1 at pH 6.0 and pH 7.4. FIG. 17B is a histogram showing that antibodies P1-061029, P1-068761, P1-068767 and VISTA.4 inhibit binding of PSGL-1 to hVISTA. FIG. 17C shows antibody blockade of VISTA-Fc binding to CHO-PSGL-1 cells by VISTA.4 (upward triangles) and by the anti-PSGL-1 antibody KPL-1 (circles). These data are representative of two independent experiments. Error bars depict the standard error of the mean.

FIG. 18A shows VISTA IgV domain: P1-068767 Fab co-crystal structure. FIG. 18A shows the overall structure of the VISTA IgV domain in complex with the P1-068767 Fab (heavy chain, dark gray; light chain, light gray). FIG. 18B shows a superimposition of the VISTA and PD-L1 IgV domains. VISTA histidine residues are depicted in stick representation. FIG. 18B shows that VISTA's IgV domain possesses an unusual histidine-rich B-sheet extension. FIG. 18C shows the molecular surface of the P1-068767 epitope (light grey electrostatic surface) as revealed by the VISTA+P1-068767 crystal structure. FIG. 18C shows that blocking antibodies bind to VISTA's histidine-rich B-sheet extension. FIG. 18D shows an enlarged view of the interface between VISTA (grey ribbon cartoon, with epitope residues H121, H122, and H123 depicted in stick representation) and P1-068767 (depicted as an electrostatic surface with its residues E100 and D102 in stick representation). FIG. 18D shows that acidic pH-selective P1-068767 engages VISTA histidines with acidic residues. FIG. 18E shows that non-blocking antibody VISTA.5 binds in a different region of hVISTA from P1-068767.

FIG. 21B shows the blocking efficiency of each antibody relative to non-blocked T cells. One-way ANOVA with Dunnett's multiple comparisons, ***, $P<0.001$. These data are representative of more than four independent experiments. Error bars depict the standard error of the mean.

FIG. 25 A-E show that VISTA: PSGL-1 binding specificity is determined by histidine and sulfotyrosine residues.

DETAILED DESCRIPTION

Definitions

Figure 1A:
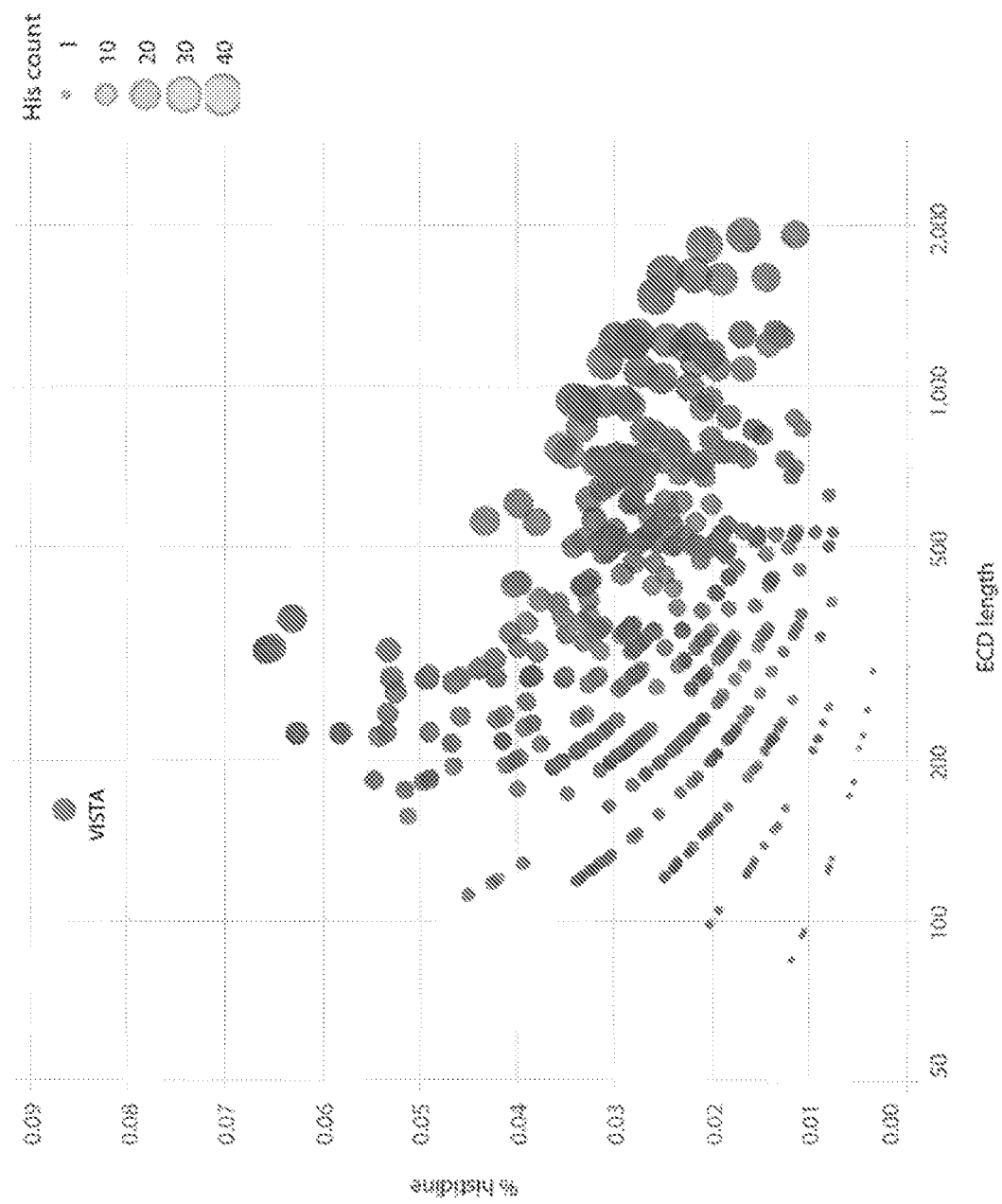

In this application, the use of "or" means "and/or" unless stated otherwise. In the context of a multiple dependent claim, the use of "or" refers back to more than one preceding independent or dependent claim in the alternative only. The terms "comprising," "including," and "having" can be used interchangeably herein. According to the present invention, an "isolated" molecule is a molecule that has been removed from its natural milieu. As such, the term "isolated" does not necessarily reflect the extent to which the molecule has been purified.

The term "polypeptide" refers to a polymer of amino acid residues, and is not limited to a minimum length. A "protein" may comprise one or more polypeptides. Such polymers of amino acid residues may contain natural or non-natural amino acid residues, and include, but are not limited to, peptides, oligopeptides, dimers, trimers, and multimers of amino acid residues. Both full-length proteins and fragments thereof are encompassed by the definition. The terms also include post-expression modifications of the polypeptide, for example, glycosylation, sialylation, acetylation, phosphorylation, and the like. Furthermore, for purposes of the present invention, a "polypeptide" or "protein" refers to a polypeptide or protein, respectively, which includes modifications, such as deletions, additions, and substitutions (generally conservative in nature), to the native sequence, as long as the protein maintains the desired activity. These modifications may be deliberate, as through site-directed mutagenesis, or may be accidental, such as through mutations of hosts that produce the proteins or errors due to PCR amplification. A protein may comprise two or more polypeptides.

"VISTA" is an abbreviation for the V-domain immunoglobulin-containing suppressor of T-cell activation protein, which is a member of the B7 family of immune checkpoint regulators. VISTA is also known as the PD-1 homolog (PD1H), B7-H5, C10orf54, differentiation of ESC-1 (Dies$^{-1}$), platelet receptor Gi24 precursor, and death domain 1a (DD1α). The term "hVISTA" or "huVISTA" herein refers to the human VISTA protein. The amino acid sequence of hVISTA, including its signal peptide is provided in SEQ ID NO:1, while the sequence without the signal peptide is provided in SEQ ID NO:2. (See the Sequence Table below.) The extracellular domain or "ECD" of VISTA or the "VISTA-ECD" refers to the portion of the VISTA protein that is located in the extracellular space, which, in the case of hVISTA, comprises the amino acids 1-162 of SEQ ID NO:2. (See also FIG. 1B.) The "IgV domain" portion of hVISTA comprises residues 5-135 of SEQ ID NO:2.

The term "leader peptide" or "leader sequence" refers to a sequence of amino acid residues located at the N terminus of a polypeptide that facilitates secretion of a polypeptide from a mammalian cell. A leader sequence may be cleaved upon export of the polypeptide from the mammalian cell, forming a mature protein. Leader sequences may be natural or synthetic, and they may be heterologous or homologous to the protein to which they are attached.

The term "antibody" or "Ab" herein is used in the broadest sense and encompasses various antibody structures, including but not limited to monoclonal antibodies, polyclonal antibodies, multispecific antibodies (e.g., bispecific antibodies), and antibody fragments so long as they exhibit the desired antigen-binding activity. As used herein, the term refers to a molecule comprising at least complementarity-determining region (CDR) 1, CDR2, and CDR3 of a heavy chain and at least CDR1, CDR2, and CDR3 of a light chain, wherein the molecule is capable of binding to antigen. The term antibody includes, but is not limited to, fragments that are capable of binding antigen, such as Fv, single-chain Fv (scFv), Fab, Fab', and (Fab')$_2$. The term antibody also includes, but is not limited to, chimeric antibodies, humanized antibodies, human antibodies, and antibodies of various species such as mouse, cynomolgus monkey, etc.

The term "heavy chain" or "HC" refers to a polypeptide comprising at least a heavy chain variable region, with or without a leader sequence. In some embodiments, a heavy chain comprises at least a portion of a heavy chain constant region. The term "full-length heavy chain" refers to a polypeptide comprising a heavy chain variable region and a heavy chain constant region, with or without a leader sequence, and with or without a C-terminal lysine (K).

The term "heavy chain variable region" or "VH" refers to a region comprising a heavy chain complementary determining region (CDR) 1, framework region (FR) 2, CDR2, FR3, and CDR3 of the heavy chain. In some embodiments, a heavy chain variable region also comprises at least a portion of an FR1 and/or at least a portion of an FR4. As specified below, in some embodiments, a heavy chain CDR1 comprises residues 26-35 of a VH SEQ ID NO herein; a heavy chain CDR2 comprises residues 50-66 of a VH SEQ ID NO herein, and a heavy chain CDR3 comprises residues 99-110 of a VH SEQ ID NO herein. In other embodiments, if specified, a heavy chain CDR1 corresponds to Kabat residues 31 to 35; a heavy chain CDR2 corresponds to Kabat residues 50 to 65; and a heavy chain CDR3 corresponds to Kabat residues 95 to 102. See, e.g., Kabat Sequences of Proteins of Immunological Interest (1987 and 1991, NIH, Bethesda, Md.). In some embodiments the heavy chain CDRs are as specified herein, such as in the sequence table below or in Table 2.

The term "light chain" or "LC" refers to a polypeptide comprising at least a light chain variable region, with or without a leader sequence. In some embodiments, a light chain comprises at least a portion of a light chain constant region. The term "full-length light chain" refers to a polypeptide comprising a light chain variable region and a light chain constant region, with or without a leader sequence.

The term "light chain variable region" or "VL" refers to a region comprising a light chain CDR1, FR2, HVR2, FR3, and HVR3. In some embodiments, a light chain variable region also comprises an FR1 and/or an FR4. As specified below, in some embodiments, a light chain CDR1 comprises residues 24-35 of a VL SEQ ID NO herein; a light chain CDR2 comprises residues 51-57 of a VL SEQ ID NO herein, and a light chain CDR3 comprises residues 90-98 of a VL SEQ ID NO herein. In other embodiments, if specified, a light chain CDR1 corresponds to Kabat residues 24 to 34; a light chain CDR2 corresponds to Kabat residues 50 to 56; and a light chain CDR3 corresponds to Kabat residues 89 to 97. See, e.g., Kabat Sequences of Proteins of Immunological Interest (1987 and 1991, NIH, Bethesda, Md.). In some embodiments, the light chain CDRs are as specified herein such as in the sequence table.

A "chimeric antibody" refers to an antibody in which a portion of the heavy and/or light chain is derived from a particular source or species, while the remainder of the heavy and/or light chain is derived from a different source or species. In some embodiments, a chimeric antibody refers to an antibody comprising at least one variable region from a first species (such as mouse, rat, cynomolgus monkey, etc.) and at least one constant region from a second species (such as human, cynomolgus monkey, etc.). In some embodiments, a chimeric antibody comprises at least one mouse variable region and at least one human constant region. In some embodiments, a chimeric antibody comprises at least one cynomolgus variable region and at least one human constant region. In some embodiments, all of the variable regions of a chimeric antibody are from a first species and all of the constant regions of the chimeric antibody are from a second species.

A "humanized antibody" refers to an antibody in which at least one amino acid in a framework region of a non-human variable region has been replaced with the corresponding amino acid from a human variable region. In some embodiments, a humanized antibody comprises at least one human constant region or fragment thereof. In some embodiments, a humanized antibody is an Fab, an scFv, a (Fab')$_2$, etc.

A "human antibody" as used herein refers to antibodies produced in humans, antibodies produced in non-human animals that comprise human immunoglobulin genes, such as XenoMouse®, and antibodies selected using in vitro methods, such as phage display, wherein the antibody repertoire is based on a human immunoglobulin sequences.

A "VISTA antibody" or "anti-VISTA antibody" as used herein refers to an antibody that specifically binds to VISTA under at least some conditions such as acidic pH. In some embodiments, the antibody may be a "huVISTA antibody" or an "anti-huVISTA antibody" indicting that it specifically binds to the human VISTA protein under at least some conditions such as at acidic pH. A VISTA antibody that specifically binds to the extracellular domain (ECD) of VISTA, for example, may be termed a "VISTA-ECD antibody."

In some embodiments, an antibody herein may contain one or more "conservative substitutions" compared to a particular, specified sequence. "Conservative amino acid substitutions" herein refer to substitutions of an amino acid residue with an amino acid residue having a similar side chain. Families of amino acid residues having similar side chains include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine, tryptophan), nonpolar side chains (e.g., alanine, valine, leucine, isoleucine, proline, phenylalanine, methionine), beta-branched side chains (e.g., threonine, valine, isoleucine) and aromatic side chains (e.g., tyrosine, phenylalanine, tryptophan, histidine). In certain embodiments, a predicted nonessential amino acid residue in an antibody herein is replaced with another amino acid residue from the same side chain family (e.g., basic, acidic, beta-branched, aromatic, uncharged polar). Methods of identifying nucleotide and amino acid conservative substitutions which do not eliminate antigen binding have been described, for example, in Brummell et al., *Biochem.* 32: 1180-1187 (1993); Kobayashi et al. *Protein Eng.* 12(10):879-884 (1999); and Burks et al. *Proc. Natl. Acad. Sci. USA* 94:412-417 (1997)).

In some embodiments, an antibody may bind with higher affinity to VISTA at acidic pH than at neutral and/or physiological pH. In some embodiments, the antibody may bind with higher affinity to VISTA at acidic pH and may only bind negligibly or nonspecifically at neutral and/or physiological pH.

A "$K_D$" or "dissociation constant" for binding of an antibody to a protein, e.g., a VISTA-ECD protein is a measure of the affinity or specific binding of the antibody to the protein, e.g., VISTA-ECD protein. A lower $K_D$ indicates improved binding or affinity over a higher $K_D$. A $K_D$ is composed of a ratio between an "off-rate" or $k_{off}$ or $k_d$ and an "on-rate" or $k_{on}$ or $k_a$ for the antibody and polypeptide. The off-rate and on-rate are the rates at which the two binding partners associate and dissociate in the system. Thus, a slower off-rate, where the on-rate remains roughly constant, leads to higher overall affinity and thus a lower $K_D$. As used herein, a $k_{off}$ of a particular value "or less" indicates that the $k_{off}$ or "off-rate" is as specified or is slower than the rate specified.

The terms "specific binding" or "specifically binds" or like terms signify that the $K_D$ for the binding of two polypeptides, such as an antibody and its polypeptide target, is less than would be the case between two random polypeptides existing under the same conditions. In other words, the $K_D$ is less than that due to nonspecific aggregation of polypeptides in the system.

In some embodiments, the antibodies specifically bind to a VISTA-ECD protein at a particular pH or pH range. An "acidic" pH herein generally refers to a pH less than 7.0, a "basic" pH generally refers to a pH higher than 7.0 and a "neutral" pH generally refers to a pH of about 7.0. A "physiological pH" herein refers to a pH in normal (i.e., non-cancerous) physiological conditions, e.g., from 7.35 to 7.45, or from 7.3 to 7.4, such as of about 7.4. Phrases such as "binding in acidic conditions" or "binding in physiological conditions" and the like herein, used in the context of binding of two molecules such as VISTA and a VISTA binding partner or VISTA and a T cell, refer to binding in acidic pH and binding in physiological pH, respectively.

When referring to an antibody that "blocks binding of" or "inhibits binding of" a ligand (or receptor) or a competing antibody to a receptor (or ligand) alone or on a cell, binding is blocked if there is an overall decrease that is statistically significant compared to a control, e.g., an overall decrease of 50% or greater, e.g., an overall decrease of 75%, 80%, 85%, 90%, 95%, or greater. An "anti-VISTA blocking antibody," for example, is one that can block binding of VISTA to PSGL-1 or another VISTA ligand or receptor or heparan sulfate proteoglycans under at least some conditions such as at acidic pH.

A "tumor model," as used herein, refers to an in vivo preclinical assay, which may be used for studying the biological activity of a VISTA-ECD antibody, and includes xenograft or native mouse tumor assay systems. In some cases, a tumor model may allow for tracking of tumor size or growth upon treatment with the antibody, and/or tracking of the presence of immune cells in the tumor, such as specific types of T-cells or NK cells, in order to determine whether an antibody has triggered or enhanced an immune response.

The term "immune stimulating agent" as used herein refers to a molecule that stimulates the immune system by either acting as an agonist of an immune-stimulatory molecule, including a co-stimulatory molecule, or acting as an antagonist of an immune inhibitory molecule, including a co-inhibitory molecule. The immune-stimulatory molecule or immune inhibitory molecule may be an immune checkpoint regulator such as VISTA or another B7 family member or another molecule as described further below. An immune stimulating agent may be a biologic, such as an antibody or antibody fragment, other protein, or vaccine, or may be a small molecule drug. An "immune stimulatory molecule" includes a receptor or ligand that acts to enhance, stimulate, induce, or otherwise "turn-on" an immune response. Immune stimulatory molecules as defined herein include co-stimulatory molecules. An "immune inhibitory molecule" includes a receptor or ligand that acts to reduce, inhibit, suppress, or otherwise "turn-off" an immune response. Immune inhibitory molecules as defined herein include co-inhibitory molecules. Such immune stimulatory and immune inhibitory molecules may be, for example, receptors or ligands found on immune cells such as a T cells, or found on cells involved in innate immunity such as NK cells.

"Percent (%) amino acid sequence identity" and "homology" with respect to a peptide, polypeptide or antibody sequence are defined as the percentage of amino acid residues in a candidate sequence that are identical with the amino acid residues in the specific peptide or polypeptide sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or MEGALIGN™ (DNASTAR) software. Those skilled in the art can determine appropriate parameters for measuring alignment, including any algorithms needed to achieve maximal alignment over the full length of the sequences being compared.

The terms "trigger" or "enhance" refer to an initiation or increase of any event (such as protein ligand binding) or to an initiation or increase of any biological activity (such as an immune response) or phenotypic characteristic or to the initiation or increase in the incidence, degree, or likelihood of that activity or characteristic. To "trigger" or "enhance" is to begin or increase an activity, function, and/or amount as compared to a reference. It is not necessary that the triggering or enhancement be complete. For example, in certain embodiments, by "enhance" is meant the ability to cause an overall increase of 20% or greater. In another embodiment, by "enhance" is meant the ability to cause an overall increase of 50% or greater. In yet another embodiment, by "enhance" is meant the ability to cause an overall increase of 75%, 85%, 90%, 95%, or greater.

The terms "inhibition" or "inhibit" more generally refer to a decrease or cessation of any event (such as protein ligand binding) or to a decrease or cessation of any phenotypic characteristic or to the decrease or cessation in the incidence, degree, or likelihood of that characteristic. To "reduce" or "inhibit" is to decrease, reduce or arrest an activity, function, and/or amount as compared to a reference. It is not necessary that the inhibition or reduction be complete. For example, in certain embodiments, by "reduce" or "inhibit" is meant the ability to cause an overall decrease of 20% or greater. In another embodiment, by "reduce" or "inhibit" is meant the ability to cause an overall decrease of 50% or greater. In yet another embodiment, by "reduce" or "inhibit" is meant the ability to cause an overall decrease of 75%, 85%, 90%, 95%, or greater.

"Treatment" as used herein, covers any administration or application of a therapeutic for disease in a human, and includes inhibiting the disease or progression of the disease or one or more disease symptoms, inhibiting or slowing the disease or its progression or one or more of its symptoms, arresting its development, partially or fully relieving the disease or one or more of its symptoms, or preventing a recurrence of one or more symptoms of the disease.

The terms "subject" and "patient" are used interchangeably herein to refer to a human.

The term "effective amount" or "therapeutically effective amount" refers to an amount of a drug effective for treatment of a disease or disorder in a subject, such as to partially or fully relieve one or more symptoms. In some embodiments, an effective amount refers to an amount effective, at dosages and for periods of time necessary, to achieve the desired therapeutic or prophylactic result.

The term "cancer" is used herein to refer to a group of cells that exhibit abnormally high levels of proliferation and growth. A cancer may be benign (also referred to as a benign tumor), pre-malignant, or malignant. Cancer cells may be solid cancer cells or leukemic cancer cells. The term "tumor growth" is used herein to refer to proliferation or growth by a cell or cells that comprise a cancer that leads to a corresponding increase in the size or extent of the cancer.

Examples of cancers applicable to methods of treatment herein include but are not limited to, carcinoma, lymphoma, blastoma, sarcoma, and leukemia. More particular nonlimiting examples of such cancers include squamous cell cancer, small-cell lung cancer, pituitary cancer, esophageal cancer, astrocytoma, soft tissue sarcoma, non-small cell lung cancer (including squamous cell non-small cell lung cancer), adenocarcinoma of the lung, squamous carcinoma of the lung, cancer of the peritoneum, hepatocellular cancer, gastrointestinal cancer, pancreatic cancer, glioblastoma, cervical cancer, ovarian cancer, liver cancer, bladder cancer, hepatoma, breast cancer, colon cancer, colorectal cancer, endometrial or uterine carcinoma, salivary gland carcinoma, kidney cancer, renal cell carcinoma, liver cancer, prostate cancer, vulval cancer, thyroid cancer, hepatic carcinoma, brain cancer, endometrial cancer, testis cancer, cholangiocarcinoma, gallbladder carcinoma, gastric cancer, melanoma, and various types of head and neck cancer (including squamous cell carcinoma of the head and neck).

Administration "in combination with" one or more further therapeutic agents includes simultaneous (concurrent) and consecutive (sequential) administration in any order.

A "pharmaceutically acceptable carrier" refers to a nontoxic solid, semisolid, or liquid filler, diluent, encapsulating material, formulation auxiliary, or carrier conventional in the art for use with a therapeutic agent that together comprise a "pharmaceutical composition" for administration to a subject. A pharmaceutically acceptable carrier is non-toxic to recipients at the dosages and concentrations employed and is compatible with other ingredients of the formulation. The pharmaceutically acceptable carrier is appropriate for the formulation employed. For example, if the therapeutic agent is to be administered orally, the carrier may be a gel capsule. If the therapeutic agent is to be administered subcutaneously, the carrier ideally is not irritable to the skin and does not cause injection site reaction.

A "chemotherapeutic agent" is a chemical compound useful in the treatment of cancer. Examples of chemotherapeutic agents that can be administered in methods herein include, but are not limited to, alkylating agents such as thiotepa and Cytoxan® cyclosphosphamide; alkyl sulfonates such as busulfan, improsulfan and piposulfan; aziridines such as benzodopa, carboquone, meturedopa, and uredopa; ethylenimines and methylamelamines including altretamine, triethylenemelamine, trietylenephosphoramide, triethiylenethiophosphoramide and trimethylolomelamine; acetogenins (especially bullatacin and bullatacinone); a camptothecin (including the synthetic analogue topotecan); bryostatin; callystatin; CC-1065 (including its adozelesin, carzelesin and bizelesin synthetic analogues); cryptophycins (particularly cryptophycin 1 and cryptophycin 8); dolastatin; duocarmycin (including the synthetic analogues, KW-2189 and CB1-TM1); eleutherobin; pancratistatin; a sarcodictyin; spongistatin; nitrogen mustards such as chlorambucil, chlornaphazine, cholophosphamide, estramustine, ifosfamide, mechlorethamine, mechlorethamine oxide hydrochloride, melphalan, novembichin, phenesterine, prednimustine, trofosfamide, uracil mustard; nitrosureas such as carmustine, chlorozotocin, fotemustine, lomustine, nimustine, and ranimnustine; antibiotics such as the enediyne antibiotics (e.g., calicheamicin, especially calicheamicin gamma1I and calicheamicin omega1I (see, e.g., Agnew, Chem Intl. Ed. Engl., 33: 183-186 (1994)); dynemicin, including dynemicin A; bisphosphonates, such as clodronate; an esperamicin; as well as neocarzinostatin chromophore and related chromoprotein enediyne antiobiotic chromophores), aclacinomysins, actinomycin, authramycin, azaserine, bleomycins, cactinomycin, carabicin, carminomycin, carzinophilin, chromomycinis, dactinomycin, daunorubicin, detorubicin, 6-diazo-5-oxo-L-norleucine, Adriamycin® doxorubicin (including morpholino-doxorubicin, cyanomorpholino-doxorubicin, 2-pyrrolino-doxorubicin and deoxydoxorubicin), epirubicin, esorubicin, idarubicin, marcellomycin, mitomycins such as mitomycin C, mycophenolic acid, nogalamycin, olivomycins, peplomycin, potfiromycin, puromycin, quelamycin, rodorubicin, streptonigrin, streptozocin, tubercidin, ubenimex, zinostatin, zorubicin; anti-metabolites such as methotrexate and 5-fluorouracil (5-FU); folic acid analogues such as denopterin, methotrexate, pteropterin, trimetrexate; purine analogs such as fludarabine, 6-mercaptopurine, thiamiprine, thioguanine; pyrimidine analogs such as ancitabine, azacitidine, 6-azauridine, carmofur, cytarabine, dideoxyuridine, doxifluridine, enocitabine, floxuridine; androgens such as calusterone, dromostanolone propionate, epitiostanol, mepitiostane, testolactone; anti-adrenals such as aminoglutethimide, mitotane, trilostane; folic acid replenisher such as frolinic acid; aceglatone; aldophosphamide glycoside; aminolevulinic acid; eniluracil; amsacrine; bestrabucil; bisantrene; edatraxate; defofamine; demecolcine; diaziquone; elfornithine; elliptinium acetate; an epothilone; etoglucid; gallium nitrate; hydroxyurea; lentinan; lonidainine; maytansinoids such as maytansine and ansamitocins; mitoguazone; mitoxantrone; mopidanmol; nitraerine; pentostatin; phenamet; pirarubicin; losoxantrone; podophyllinic acid; 2-ethylhydrazide; procarbazine; PSK® polysaccharide complex (JHS Natural Products, Eugene, OR); razoxane; rhizoxin; sizofiran; spirogermanium; tenuazonic acid; triaziquone; 2,2',2''-trichlorotriethylamine; trichothecenes (especially T-2 toxin, verracurin A, roridin A and anguidine); urethan; vindesine; dacarbazine; mannomustine; mitobronitol; mitolactol; pipobroman; gacytosine; arabinoside ("Ara-C"); cyclophosphamide; thiotepa; taxoids, e.g., Taxol® paclitaxel (Bristol-Myers Squibb Oncology, Princeton, N.J.), Abraxane® Cremophor-free, albumin-engineered nanoparticle formulation of paclitaxel (American Pharmaceutical Partners, Schaumberg, Illinois), and Taxotere® doxetaxel (Rhône-Poulenc Rorer, Antony, France); chloranbucil; Gemzar® gemcitabine; 6-thioguanine; mercaptopurine; methotrexate; platinum analogs such as cisplatin, oxaliplatin and carboplatin; vinblastine; platinum; etoposide (VP1-16); ifosfamide; mitoxantrone; vincristine; Navelbine® vinorelbine; novantrone; teniposide; edatrexate; daunomycin; aminopterin; xeloda; ibandronate; irinotecan (Camptosar, CPT-11) (including the treatment regimen of irinotecan with 5-FU and leucovorin); topoisomerase inhibitor RFS 2000; difluoromethylornithine (DMFO); retinoids such as retinoic acid; capecitabine; combretastatin; leucovorin (LV); oxaliplatin, including the oxaliplatin treatment regimen (FOLFOX); inhibitors of PKC-alpha, Raf, H-Ras, EGFR (e.g., erlotinib (Tarceva®)) and VEGF-A that reduce cell proliferation and pharmaceutically acceptable salts, acids or derivatives of any of the above.

Further nonlimiting exemplary chemotherapeutic agents that can be administered in methods herein include antihormonal agents that act to regulate or inhibit hormone action on cancers such as anti-estrogens and selective estrogen receptor modulators (SERMs), including, for example, tamoxifen (including Nolvadex® tamoxifen), raloxifene, droloxifene, 4-hydroxytamoxifen, trioxifene, keoxifene, LY 117018, onapristone, and Fareston® toremifene; aromatase inhibitors that inhibit the enzyme aromatase, which regulates estrogen production in the adrenal glands, such as, for example, 4(5)-imidazoles, aminoglutethimide, Megase® megestrol acetate, Aromasin® exemestane, formestanie, fadrozole, Rivisor® vorozole, Femara® letrozole, and Arimidex® anastrozole; and anti-androgens such as flutamide, nilutamide, bicalutamide, leuprolide, and goserelin; as well as troxacitabine (a 1,3-dioxolane nucleoside cytosine analog); antisense oligonucleotides, particularly those which inhibit expression of genes in signaling pathways implicated in abherant cell proliferation, such as, for example, PKC-alpha, Ralf and H-Ras; ribozymes such as a VEGF expression inhibitor (e.g., Angiozyme® ribozyme) and a HER2 expression inhibitor; vaccines such as gene therapy vaccines, for example, Allovectin® vaccine, Leuvectin® vaccine, and Vaxid® vaccine; Proleukin® rIL-2; Lurtotecan® topoisomerase 1 inhibitor; Abarelix® rmRH; and pharmaceutically acceptable salts, acids or derivatives of any of the above.

An "anti-angiogenesis agent" or "angiogenesis inhibitor" refers to a small molecular weight substance, a polynucleotide (including, e.g., an inhibitory RNA (RNAi or siRNA)), a polypeptide, an isolated protein, a recombinant protein, an antibody, or conjugates or fusion proteins thereof, that inhibits angiogenesis, vasculogenesis, or undesirable vascular permeability, either directly or indirectly. It should be understood that the anti-angiogenesis agent includes those agents that bind and block the angiogenic activity of the angiogenic factor or its receptor. For example, an anti-angiogenesis agent that can be administered in methods herein can include an antibody or other antagonist to an angiogenic agent, e.g., antibodies to VEGF-A (e.g., bevacizumab (Avastin®)) or to the VEGF-A receptor (e.g., KDR receptor or Flt-1 receptor), anti-PDGFR inhibitors such as Gleevec® (Imatinib Mesylate), small molecules that block VEGF receptor signaling (e.g., PTK787/ZK2284, SU6668, Sutent®/SU11248 (sunitinib malate), AMG706, or those described in, e.g., international patent application WO 2004/113304). Anti-angiogenesis agents also include native angiogenesis inhibitors, e.g., angiostatin, endostatin, etc. See, e.g., Klagsbrun and D'Amore (1991) Annu. Rev. Physiol. 53:217-39; Streit and Detmar (2003) Oncogene 22:3172-3179 (e.g., Table 3 listing anti-angiogenic therapy in malignant melanoma); Ferrara & Alitalo (1999) Nature Medicine 5(12):1359-1364; Tonini et al. (2003) Oncogene 22:6549-6556 (e.g., Table 2 listing known anti-angiogenic factors); and, Sato (2003) Int. J. Clin. Oncol. 8:200-206 (e.g., Table 1 listing anti-angiogenic agents used in clinical trials).

A "growth inhibitory agent" as used herein refers to a compound or composition that inhibits growth of a cell (such as a cell expressing VEGF) either in vitro or in vivo. Thus, the growth inhibitory agent that can be administered in methods herein may be one that significantly reduces the percentage of cells (such as a cell expressing VEGF) in S phase. Examples of growth inhibitory agents include, but are not limited to, agents that block cell cycle progression (at a place other than S phase), such as agents that induce G1 arrest and M-phase arrest. Classical M-phase blockers include the vincas (vincristine and vinblastine), taxanes, and topoisomerase II inhibitors such as doxorubicin, epirubicin, daunorubicin, etoposide, and bleomycin. Those agents that arrest G1 also spill over into S-phase arrest, for example, DNA alkylating agents such as tamoxifen, prednisone, dacarbazine, mechlorethamine, cisplatin, methotrexate, 5-fluorouracil, and ara-C. Further information can be found in Mendelsohn and Israel, eds., *The Molecular Basis of Cancer*, Chapter 1, entitled "Cell cycle regulation, oncogenes, and antineoplastic drugs" by Murakami et al. (W.B. Saunders, Philadelphia, 1995), e.g., p. 13. The taxanes (paclitaxel and docetaxel) are anticancer drugs both derived from the yew tree. Docetaxel (Taxotere®, Rhone-Poulenc Rorer), derived from the European yew, is a semisynthetic analogue of paclitaxel (Taxol®, Bristol-Myers Squibb). Paclitaxel and docetaxel promote the assembly of microtubules from tubulin dimers and stabilize microtubules by preventing depolymerization, which results in the inhibition of mitosis in cells.

The term "anti-neoplastic composition" refers to a composition useful in treating cancer comprising at least one active therapeutic agent. Examples of therapeutic agents include, but are not limited to, e.g., chemotherapeutic agents, growth inhibitory agents, cytotoxic agents, agents used in radiation therapy, anti-angiogenesis agents, cancer immunotherapeutic agents, apoptotic agents, anti-tubulin agents, and other-agents to treat cancer, such as anti-HER-2 antibodies, anti-CD20 antibodies, an epidermal growth factor receptor (EGFR) antagonist (e.g., a tyrosine kinase inhibitor), HER1/EGFR inhibitor (e.g., erlotinib (Tarceva®), platelet derived growth factor inhibitors (e.g., Gleevec® (Imatinib Mesylate)), a COX-2 inhibitor (e.g., celecoxib), interferons, CTLA4 inhibitors (e.g., anti-CTLA antibody ipilimumab (YERVOY®)), PD-1 ore PD-L1 inhibitors (e.g., OPDIVO®, KEYTRUDA®, TECENTRIQ®, BAVENCIO®, IMFINZI®), TIM3 inhibitors (e.g., anti-TIM3 antibodies), cytokines, antagonists (e.g., neutralizing antibodies) that bind to one or more of the following targets ErbB2, ErbB3, ErbB4, PDGFR-beta, BlyS, APRIL, BCMA, CTLA4, TIM3, or VEGF receptor(s), TRAIL/Apo2, and other bioactive and organic chemical agents, etc. Combinations thereof are also included in this disclosure.

Antibodies Specifically Binding to VISTA-ECD at Acidic pH

Because VISTA has a large number of histidine residues in its extracellular domain (ECD), its folding and overall structure, as well as the surface available for the binding of ligands such as antibodies, may differ at acidic pH compared to neutral pH, in particular, near pH 6.5, which is the $pK_a$ for histidine. Since tumor microenvironments are generally acidic, for binding to VISTA in those microenvironments, an antibody may need to bind with specificity to VISTA at acidic pH where at least some of the surface histidine residues are more likely to be protonated.

The Sequence Table below provides the amino acid sequence of human VISTA (hVISTA) with or without signal peptide (SEQ ID NO: 1 and SEQ ID NO: 2 (mature hVISTA)), respectively. The signal peptide constitutes amino acid residues 1-32 of SEQ ID NO: 1. The extracellular domain (ECD) consists of amino acid residues 1-162 of SEQ ID NO: 2). The IgV domain constitutes amino acids residues 37-167 of SEQ ID NO: 1 and amino acid residues 5-135 of SEQ ID NO: 2. The stalk region is at amino acid residues 172-194 of SEQ ID NO: 1 and amino acid residues 136-162 of SEQ ID NO: 2; the transmembrane domain is at amino acid residues 195-216 of SEQ ID NO: 1 and amino acid residues 163-184 of SEQ ID NO: 2. Amino acid residue 187 of SEQ ID NO: 1 and 155 of SEQ ID NO: 2 (bold and underlined) can be either D or E, which represents a polymorphism in hVISTA. That residue is shown in bold, underlining. Accordingly, SEQ ID NO:1 and SEQ ID NO:2 encompass both of the human polymorphisms at that residue. The histidine residues in the ECD of VISTA are grey-shaded.

Anti-VISTA antibodies (Abs) may specifically bind to the VISTA-ECD or fragments thereof, e.g., comprising the IgV domain of VISTA or a region from hVISTA comprising, e.g., amino acids 20-95, 20-70 35-70, 35-95, 35-127 or 37-125 of SEQ ID NO: 2 at acidic pH. In certain embodiments, an Ab specifically binds to the VISTA-ECD protein at a pH that is less than pH 7.0. In certain embodiments, an Ab specifically binds to the VISTA-ECD protein at a pH that is less than pH 6.8. In certain embodiments, an Ab specifically binds to the VISTA-ECD protein at a pH that is less than pH 6.5. In certain embodiments, an Ab specifically binds to the VISTA-ECD protein at a pH that is less than pH 6.3. In certain embodiments, an Ab specifically binds to the VISTA-ECD protein at a pH that is less than pH 6.0. In certain embodiments, an Ab specifically binds to the VISTA-ECD protein at a pH that is less than pH 5.8. In certain embodiments, an Ab specifically binds to the VISTA-ECD protein at a pH that is less than pH 5.5. In certain embodiments, an Ab specifically binds to the VISTA-ECD protein at a pH that is less than pH 5.3. In certain embodiments, an Ab specifically binds to the VISTA-ECD protein at a pH that is less than pH 5.0.

Certain Abs specifically bind to a VISTA-ECD protein at a pH within a range of pH 5.0-pH 7.0. Certain Abs specifically bind to the VISTA-ECD protein at a pH within a range of pH 5.0-pH 6.5. Certain Abs specifically bind to the VISTA-ECD protein at a pH within a range of pH 5.0-pH 6.0. Certain Abs specifically bind to the VISTA-ECD protein at a pH within a range of pH 5.5-pH 7.0. Certain Abs specifically bind to the VISTA-ECD protein at a pH within a range of pH 5.5-pH 6.5. Certain Abs specifically bind to the VISTA-ECD protein at a pH within a range of pH 6.0-6.5.

Provided herein are also Abs that bind to a VISTA-ECD protein, such as hVISTA-ECD or fragments thereof comprising the IgV domain of VISTA or a region from hVISTA comprising, e.g., amino acids 20-95, 20-70 35-70, 35-95, 35-127 or 37-125 of SEQ ID NO:2 at a pH of 6.5 or less, with a $K_D$ of $10^{-6}$ M or less. In some embodiments, the Abs bind with a $K_D$ of $10^{-7}$ M or less. In some embodiments, the Abs bind with a $K_D$ of $10^{-8}$ M or less. In some embodiments, the Abs bind with a $K_D$ of $10^{-9}$ M. In some embodiments, the Abs bind with a $K_D$ of $10^{-10}$ M or less. For example, an Ab may bind to the VISTA-ECD protein at a pH of 6.5 or less with a $K_D$ of $10^{-8}$ M or less.

Provided herein are also Abs that bind to the VISTA-ECD protein within a pH range of 6.0-6.5 with a $K_D$ of $10^{-6}$ M or less. In some embodiments, the Abs bind with a $K_D$ of $10^{-7}$ M or less. In some embodiments, the Abs bind with a $K_D$ of $10^{-8}$. M or less. In some embodiments, the Abs bind with a $K_D$ of $10^{-9}$ M. In some embodiments, the Abs bind with a $K_D$ of $10^{-10}$ M or less. For example, an Ab may bind to the VISTA-ECD protein at a pH of 6.5 or less, e.g., within a pH range of 6.0-6.5, with a $K_D$ of $10^{-7}$ M or less. Further, an Ab may bind to the VISTA-ECD protein at a pH of 6.5 or less, e.g., within a pH range of 6.0-6.5, with a $K_D$ of $10^{-8}$M or less. An Ab may bind to hVISTA-ECD at a pH of 6.5 or less, e.g., within a pH range of 6.0-6.5, with a $K_D$ of $10^{-9}$ M or less.

Provided herein are also Abs that specifically bind to a VISTA-ECD protein, such as hVISTA-ECD or fragments thereof comprising the IgV domain of VISTA or a region from hVISTA comprising, e.g., amino acids 20-95, 20-70 35-70, 35-95, 35-127 or 37-125 of SEQ ID NO:2, e.g., at a pH of 6.5 or less, with a $k_{off}$ of $10^{-5}$ s$^{-1}$ or less at either 25° C. or at 37° C. In some embodiments, the Abs have a $k_{off}$ of $10^{-4}$ s$^{-1}$ or less at either 25° C. or at 37° C. In some embodiments, the Abs have a $k^{off}$ of 2 $10^{-4}$ s$^{-1}$ or less at either 25° C. or at 37° C. In some embodiments, the Abs have a $k_{off}$ of 5 $10^{-4}$ s$^{-1}$ or less at either 25° C. or at 37° C. In some embodiments, the Abs have a $k_{off}$ of 7 $10^{-4}$ s$^{-1}$ or less at either 25° C. or at 37° C. In some embodiments, the Abs have a $k_{off}$ of $10^{-3}$ s$^{-1}$ or less at either 25° C. or at 37° C. In some embodiments, the Abs have a $k_{off}$ of 2 $10^{-3}$ s$^{-1}$ or less at either 25° C. or at 37° C. In some embodiments, the Abs have a $k_{off}$ of 5 $10^{-3}$ s$^{-1}$ or less at either 25° C. or at 37° C. In some embodiments, the Abs have a $k_{off}$ of 7 $10^{-3}$ s$^{-1}$ or less at either 25° C. or at 37° C. In some embodiments, the Abs have a $k_{off}$ of $10^{-2}$ s$^{-1}$ at either 25° C. or at 37° C. In some embodiments, the Abs have a $k_{off}$ of $10^{-1}$ s$^{-1}$ or less at either 25° C. or at 37° C. For example, an Ab may specifically bind to the VISTA-ECD protein at a pH of 6.5 or less with a $k_{off}$ of $10^{-3}$ s$^{-1}$ or less at either 25° C. or at 37° C. An Ab may specifically bind to hVISTA-ECD at a pH of 6.5 or less with a $k_{off}$ of $10^{-3}$ s$^{-1}$ or less at either 25° C. or at 37° C. Further, an Ab may specifically bind to the VISTA-ECD protein at a pH of 6.5 or less with a $k_{off}$ of $10^{-2}$ s$^{-1}$ or less at either 25° C. or at 37° C.

Provided herein are Abs that bind to a VISTA-ECD protein, such as hVISTA-ECD or fragments thereof comprising the IgV domain of VISTA or a region from hVISTA comprising, e.g., amino acids 20-95, 20-70 35-70, or 35-95, 35-95, 35-127 or 37-125 of SEQ ID NO:2, e.g., at a pH of 6.5 or less, with (i) a $K_D$ of $10^{-6}$ M or less, $10^{-7}$ M or less, $10^{-8}$ M or less, $10^{-9}$ M or less or $10^{-10}$ M or less and (ii) a $k_{off}$ rate of $10^{-5}$ s$^{-1}$ or less, $10^{-4}$ (or 2, 5 or 7 $10^{-4}$) s$^{-1}$ or less, $10^{-3}$ (or 2, 5 or 7 $10^{-4}$) s$^{-1}$ or less, $10^{-2}$ s$^{-1}$ or less, or $10^{-1}$ s$^{-1}$ or less, as measured, e.g., at 25° C. or at 37° C. For example, an Ab may bind to the VISTA-ECD protein at a pH of 6.5 or less with a $K_D$ of 10 M or less and a $k_{off}$ rate of $10^{-3}$ s$^{-1}$ or less, as measured, e.g., at 25° C. or at 37° C. An Ab may bind to the VISTA-ECD protein at a pH of 6.5 or less with a $K_D$ of $10^{-8}$ M or less and a $k_{off}$ rate of $10^{-3}$ s$^{-1}$ or less, as measured, e.g., at 25° C. or at 37° C. An Ab may bind to the VISTA-ECD protein at a pH of 6.5 or less with a $K_D$ of $10^{-8}$ M or less and a $k_{off}$ rate of $10^{-2}$ s$^{-1}$ or less, as measured, e.g., at 25° C. or at 37° C. For example, an Ab may bind to hVISTA-ECD at a pH of 6.5 or less with a $K_D$ of $10^{-7}$ M or less and a $k_{off}$ rate of $10^{-3}$ s$^{-1}$ or less, as measured, e.g., at 25° C. or at 37° C. An Ab may bind to hVISTA-ECD at a pH of 6.5 or less with a $K_D$ of $10^{-9}$ M or less and a $k_{off}$ rate of $10^{-3}$ s$^{-1}$ or less, as measured, e.g., at 25° C. or at 37° C. An Ab may bind to hVISTA-ECD at a pH of 6.5 or less with a $K_D$ of $10^{-9}$ M or less and a $k_{off}$ rate of $10^{-2}$ s$^{-1}$ or less, as measured, e.g., at 25° C. or at 37° C. An Ab may bind to hVISTA-ECD at a pH of 6.5 or less with a $K_D$ of $10^{-8}$ M or less and a $k_{off}$ rate of $10^{-4}$ (or 2, 5 or 7 $10^{-4}$) s$^{-1}$ or less, as measured, e.g., at 25° C. or at 37° C. An Ab may bind to hVISTA-ECD at a pH of 6.5 or less with a $K_D$ of $10^{-8}$ M or less and a $k_{off}$ rate of $10^{-5}$ (or 2, 5 or 7 $10^{-5}$) s$^{-1}$ or less, as measured, e.g., at 25° C. or at 37° C. An Ab may bind to hVISTA-ECD at a pH of 6.5 or less with a $K_D$ of $10^{-9}$ M or less and a $k_{off}$ rate of $10^{-4}$ (or 2, 5 or 7 $10^{-4}$) s$^{-1}$ or less, as measured, e.g., at 25° C. or at 37° C. An Ab may bind to hVISTA-ECD at a pH of 6.5 or less with a $K_D$ of $10^{-9}$ M or less and a $k_{off}$ rate of $10^{-5}$ (or 2, 5 or 7 $10^{-5}$) s$^{-1}$ or less, as measured, e.g., at 25° C. or at 37° C.

Provided herein are Abs that specifically bind to the VISTA-ECD protein, e.g., at a pH of 6.5 or less, with a $k_{on}$ of $10^4$ M$^{-1}$ s$^{-1}$ or higher at 25° C. or at 37° C. In some such embodiments, the Abs may bind with a $k_{on}$ of $10^5$ M$^{-1}$ s$^{-1}$ or higher. In some such embodiments, the Abs may bind with a $k_{on}$ of $10^6$ M$^{-1}$ s$^{-1}$ or higher. In some such embodiments, the Abs may bind with a $k_{on}$ of $10^7$ M$^{-1}$ s$^{-1}$ or higher. For example, an Ab may bind to the VISTA-ECD protein at a pH of 6.5 or less with a $k_{on}$ of $10^6$ M$^{-1}$ s$^{-1}$ or higher, as measured, e.g., at 25° C. or at 37° C. For example, an Ab may bind to the ECD of hVISTA at a pH of 6.5 or less with a $k_{on}$ of $10^6$ M$^{-1}$ s$^{-1}$ or higher, as measured, e.g., at 25° C. or at 37° C.

Provided herein are Abs that bind to the VISTA-ECD protein, e.g., at a pH of 6.5 or less, with (i) a $K_D$ of $10^{-6}$ M or less, $10^{-7}$ M or less, $10^{-8}$ M or less, $10^{-9}$ M or less or $10^{-10}$ M or less and (ii) a $k_{on}$ of $10^4$ M$^{-1}$ s$^{-1}$ or higher, $10^5$ M$^{-1}$ s$^{-1}$ or higher, $10^6$ M$^{-1}$ s$^{-1}$ or higher, $10^7$ M$^{-1}$ s$^{-1}$ or higher, as measured, e.g., at 25° C. or at 37° C. For example, an Ab may bind to the VISTA-ECD protein at a pH of 6.5 or less with a $K_D$ of $10^{-7}$ M or less and a $k_{on}$ rate of $10^6$ M$^{-1}$ s$^{-1}$ or higher, as measured, e.g., at 25° C. or at 37° C. For example, an Ab may bind to the VISTA-ECD protein at a pH of 6.5 or less with a $K_D$ of $10^8$ M or less and a $k_{on}$ rate of $10^6$ M$^{-1}$ s$^{-1}$ or higher, as measured, e.g., at 25° C. or at 37° C. For example, an Ab may bind to hVISTA-ECD at a pH of 6.5 or less with a $K_D$ of $10^{-7}$ M or less and a $k_{on}$ rate of $10^6$ M$^{-1}$ s$^{-1}$ or higher, as measured, e.g., at 25° C. or at 37° C. For example, an Ab may bind to hVISTA-ECD at a pH of 6.5 or less with a $K_D$ of $10^{-8}$ M or less and a $k_{on}$ rate of $10^6$ M$^{-1}$ s$^{-1}$ or higher, as measured, e.g., at 25° C. or at 37° C.

In some embodiments, an Ab may bind to the VISTA-ECD protein at a pH of 6.5 or less with a $K_D$ of $10^{-7}$ M or less as well as with a $k_{off}$ of $10^{-5}$ s$^{-1}$ or less, 2 $10^{-5}$ s$^{-1}$ or less, 5 $10^{-5}$ s$^{-1}$ or less, 7 $10^{-5}$ s$^{-1}$ or less, $10^{-4}$ s$^{-1}$ or less, 2 $10^{-4}$ s$^{-1}$ or less, 5 $10^4$ s$^{-1}$ or less, 7 $10^{-4}$ s$^{-1}$ or less, $10^{-3}$ s$^{-1}$ or less, 2 $10^{-3}$ s$^{-1}$ or less, 5 $10^{-3}$ s$^{-1}$ or less, 7 $10^{-3}$ s$^{-1}$ or less, $10^{-2}$ s$^{-1}$ or less, or $10^{-1}$ s$^{-1}$ or less, as measured, e.g., at 25° C. or at 37° C. In some embodiments, an Ab may bind to the VISTA-ECD protein at a pH of 6.5 or less with a $K_D$ of $10^{-9}$ M or less as well as with a $k_{off}$ of $10^{-5}$ s$^{-1}$ or less, $10^{-4}$ s$^{-1}$ or less, $10^{-3}$ s$^{-1}$ or less, $10^{-2}$ s$^{-1}$ or less, or $10^{-1}$ s$^{-1}$ or less, as measured, e.g., at 25° C. or at 37° C. In some such embodiments, an Ab may bind to the VISTA-ECD protein at a pH of 6.5 or less with a $K_D$ of 10-10 M or less as well as with a $k_{off}$ of $10^{-5}$ s$^{-1}$ or less, $10^{-4}$ s$^{-1}$ or less, $10^{-3}$ s$^{-1}$ or less, $10^{-2}$ s$^{-1}$ or less, or $10^{-1}$ s$^{-1}$ or less, as measured, e.g., at 25° C. or at 37° C.

In some embodiments, an Ab may bind to the VISTA-ECD protein at a pH of 6.5 or less with a $K_D$ of $10^{-7}$ M or less as well as with a $k_{on}$ of $10^4$ M$^{-1}$ s$^{-1}$ or higher, $10^5$ M$^{-1}$ s$^{-1}$ or higher, $10^6$ M$^{-1}$ s$^{-1}$ or higher, $10^7$ M$^{-1}$ s$^{-1}$ or higher, as measured, e.g., at 25° C. or at 37° C. In some embodiments, an Ab may bind to the VISTA-ECD protein at a pH of 6.5 or less with a $K_D$ of $10^{-8}$ M or less as well as with a $k_{on}$ of $10^4$ M$^{-1}$ s$^{-1}$ or higher, $10^5$ M$^{-1}$ s$^{-1}$ or higher, $10^6$ M$^{-1}$ s$^{-1}$ or higher, $10^7$ M$^{-1}$ s$^{-1}$ or higher, as measured, e.g., at 25° C. or at 37° C. In some embodiments, an Ab may bind to the VISTA-ECD protein at a pH of 6.5 or less with a $K_D$ of $10^{-9}$ M or less as well as with a $k_{on}$ of $10^4$ M$^{-1}$ s$^{-1}$ or higher, $10^5$ M$^{-1}$ s$^{-1}$ or higher, $10^6$ M$^{-1}$ s$^{-1}$ or higher, $10^7$ M$^{-1}$ s$^{-1}$ or higher, as measured, e.g., at 25° C. or at 37° C. In some such embodiments, an Ab may bind to the VISTA-ECD protein at a pH of 6.5 or less with a $K_D$ of $10^{-10}$ M or less as well as with a $k_{on}$ of $10^4$ M$^{-1}$ s$^{-1}$ or higher, $10^5$ M$^{-1}$ s$^{-1}$ or higher, $10^6$ M$^{-1}$ s$^{-1}$ or higher, $10^7$ M$^{-1}$ s$^{-1}$ or higher, as measured, e.g., at 25° C. or at 37° C.

In some embodiments, an Ab may bind to the VISTA-ECD protein at a pH of 6.5 or less with a $K_D$ of $10^{-7}$ M or less as well as with a $k_{off}$ of $10^{-5}$ s$^{-1}$ or less, $10^{-4}$ s$^{-1}$ or less, $10^{-3}$ s$^{-1}$ or less, $10^{-2}$ s$^{-1}$ or less, or $10^{-1}$ s$^{-1}$ or less, as measured, e.g., at 25° C. or at 37° C., and a $k_{on}$ of $10^4$ $M^{-1}$ $s^{-1}$ or higher, $10^5$ $M^{-1}$ $s^{-1}$ or higher, $10^6$ $M^{-1}$ $s^{-1}$ or higher, $10^7$ $M^{-1}$ $s^{-1}$ or higher, as measured, e.g., at 25° C. or at 37° C. In some embodiments, an Ab may bind to the VISTA-ECD protein at a pH of 6.5 or less with a $K_D$ of $10^{-8}$ M or less as well as with a $k_{off}$ of $10^{-5}$ $s^{-1}$ or less, $10^{-4}$ $s^{-1}$ or less, $10^{-3}$ $s^{-1}$ or less, $10^{-2}$ $s^{-1}$ or less, or $10^{-1}$ $s^{-1}$ or less, as measured, e.g., at 25° C. or at 37° C., and a $k_{on}$ of $10^4$ $M^{-1}$ $s^{-1}$ or higher, $10^5$ $M^{-1}$ $s^{-1}$ or higher, $10^6$ $M^{-1}$ $s^{-1}$ or higher, $10^7$ $M^{-1}$ $s^{-1}$ or higher, as measured, e.g., at 25° C. or at 37° C. In some embodiments, an Ab may bind to the VISTA-ECD protein at a pH of 6.5 or less with a $K_D$ of $10^{-9}$ M or less as well as with a $k_{off}$ of $10^{-5}$ $s^{-1}$ or less, $10^{-4}$ $s^{-1}$ or less, $10^{-3}$ $s^{-1}$ or less, $10^{-2}$ $s^{-1}$ or less, or $10^{-1}$ $s^{-1}$ or less, as measured, e.g., at 25° C. or at 37° C., and a $k_{on}$ of $10^4$ $M^{-1}$ $s^{-1}$ or higher, $10^5$ MA $s^{-1}$ or higher, $10^6$ $M^{-1}$ $s^{-1}$ or higher, $10^7$ $M^{-1}$ $s^{-1}$ or higher, as measured, e.g., at 25° C. or at 37° C. In some such embodiments, an Ab may bind to the VISTA-ECD protein at a pH of 6.5 or less with a $K_D$ of $10^{-10}$ M or less as well as with a $k_{off}$ of $10^{-5}$ $s^{-1}$ or less, $10^{-4}$ $s^{-1}$ or less, $10^{-3}$ $s^{-1}$ or less, $10^{-2}$ $s^{-1}$ or less, or $10^{-1}$ $s^{-1}$ or less, as measured, e.g., at 25° C. or at 37° C., and a $k_{on}$ of $10^4$ $M^{-1}$ $s^{-1}$ or higher, $10^5$ $M^{-1}$ $s^{-1}$ or higher, $10^6$ $M^{-1}$ $s^{-1}$ or higher, $10^7$ $M^{-1}$ $s^{-1}$ or higher, as measured, e.g., at 25° C. or at 37° C.

As noted also above, in some of the above embodiments, the VISTA-ECD protein is hVISTA-ECD or is a portion of hVISTA-ECD such as, for example, the IgV domain. In some of the above embodiments, the Ab may bind specifically to an epitope comprising amino acids 20-95 of SEQ ID NO:2. In some of the above embodiments, the Ab may bind specifically to an epitope comprising amino acids 20-70 of SEQ ID NO:2. In some of the above embodiments, the Ab may bind specifically to an epitope comprising amino acids 35-95 of SEQ ID NO:2. In some of the above embodiments, the Ab may bind specifically to an epitope comprising amino acids 35-70 of SEQ ID NO:2. In some embodiments above, the epitope is a three-dimensional epitope that comprises not only one of the above portions of SEQ ID NO:2 from residues 20-95, 20-70, 35-95, or 35-70, but also another portion of SEQ ID NO:2, such as residues 95-105 of SEQ ID NO:2. In certain embodiments, an Ab binds to the epitope of hVISTA to which an Ab described in WO2015/097536 binds. For example, an Ab may compete or cross-compete for binding to hVISTA with an Ab disclosed in WO2015/097536. In certain embodiments, an Ab binds to a conformational epitope of human VISTA. In certain embodiments, an Ab binds to a conformational epitope that comprises, or is present within, residues 103-111 of SEQ ID NO: 2 and 136-146 of SEQ ID NO:2 for human VISTA. In certain embodiments, an Ab binds to a conformational epitope that comprises, or is present within, residues 24-36, 54-65, and 100-102 of SEQ ID NO:2 for human VISTA. In certain embodiments, an Ab binds to a conformational epitope that comprises amino acid residues in the FG loop of human VISTA. In some embodiments, an Ab binds to a polypeptide comprising amino acid residues 35 to 127 and/or 37-125 of SEQ ID NO: 2. In some embodiments, an Ab binds to a VISTA ECD polypeptide or portion thereof comprising amino acid residues 350-127 of SEQ ID NO: 2, but the antibody does not bind or binds with reduced affinity to the VISTA ECD polyptide or portion thereof comprising an amino acid substitution, wherein the substitution (1) is substitution of one of the following amino acid residues: T35, Y37, K38, T39, Y41, R54, T61, F62, Q63, L65, H66, L67, H68, H69, F97, L115, V117, 1119, H121, H122, S124, E125, R127 and SEQ ID NO: 2 or (2) is a substitution of one of the following amino acid residues: Y37, T39, R54, F62, Q63, H66, L115, V117, I119, S124, or E125. In some embodiments, an anti-VISTA antibody has the same binding characteristics (or significantly the same binding characteristics) as an antibody described herein, e.g., as set forth in the Examples and/or in the claims.

Some of the above antibodies may show differential binding affinity for VISTA-ECD proteins depending upon pH. Certain Abs specifically binding to a VISTA-ECD protein in acidic conditions, e.g., at pH 6.5 or less, also specifically bind the VISTA-ECD protein at neutral and/or alkaline pH with similar affinity (i.e. they are "pan binders"). For example, some such Abs may bind to the VISTA-ECD protein with a $K_D$ of $10^{-7}$ M or less at both pH 6.5 and at pH 7.0 (at a constant temperature, e.g., of 25° C. or at 37° C.) such that the $K_D$ at pH 6.5 is within 1.5-fold of the $K_D$ at pH 7.0. Some such Abs may bind to the VISTA-ECD protein with a $K_D$ of $10^{-8}$ M or less at both pH 6.5 and at pH 7.0 (at a constant temperature, e.g., of 25° C. or at 37° C.) such that the $K_D$ at pH 6.5 is within 1.5-fold of the $K_D$ at pH 7.0. Some such Abs may bind to hVISTA-ECD with a $K_D$ of $10^{-8}$ M or less at both pH 6.5 and at pH 7.0 (at a constant temperature, e.g., of 25° C. or at 37° C.) such that the $K_D$ at pH 6.5 is within 1.5-fold of the $K_D$ at pH 7.0.

Certain Abs specifically binding to a VISTA-ECD protein in acidic conditions, e.g., at pH 6.5 or less, may bind the VISTA-ECD protein at neutral, physiological, and/or alkaline conditions with lower affinity ("pH sensitive binders" or "pH sensitive Abs"). Certain Abs specifically binding to a VISTA-ECD protein in acidic conditions, e.g., at pH 6.5 or less, may have non significant, e.g., nearly undetectable, binding to the VISTA-ECD protein in neutral, physiological and/or alkaline conditions. For example, in some embodiments, Abs may bind to the VISTA-ECD protein with a $K_D$ of $10^{-8}$ M or less at pH 6.5 and with a $K_D$ of more than $10^{-8}$ M at pH 7.0 and/or pH 7.4. In some such embodiments, Abs may bind to the VISTA-ECD protein with a $K_D$ of $10^{-8}$ M or less at pH 6.5 and with a $K_D$ at pH 7.0 and/or pH 7.4 that is more than 1.5-fold higher than that at pH 6.5. In certain embodiments, a pH sensitive Ab is provided that specifically binds to the VISTA-ECD protein with a $K_D$ that is at least 1.5 fold, 2 fold, 5 fold, 10 fold, 20 fold, 50 fold, 100 fold, 300 fold, 500 fold, 1000 fold, or 5000 fold lower at pH 6.5 than at pH 7.0 (at a constant temperature, e.g., of 25° C. or at 37° C.). For example, in some cases an Ab binds to the VISTA-ECD protein with a $K_D$ that is at least 1.5 fold, 2 fold, 5 fold, 10 fold, 20 fold, 50 fold, 100 fold, 300 fold, 500 fold, 1000 fold, or 5000 fold less at pH 6.0, relative to pH 7.0 and/or pH 7.4 or higher (at a constant temperature, e.g., of 25° C. or at 37° C.).

In certain embodiments, an Ab specifically binds to a VISTA-ECD protein with a $k_{off}$ that is lower in acidic conditions relative to that in neutral, physiological, or alkaline conditions. In certain embodiments, an Ab is provided that binds to the VISTA-ECD protein in acidic conditions with a $k_{off}$ that is at least 1.5 fold, 2 fold, 5 fold, 10 fold, 20 fold, 50 fold, 100 fold, or 1000 fold lower at pH 6.5 than the $k_{off}$ at pH 7.0 and/or pH 7.4, as measured, e.g., at 25° C. or at 37° C. In other words, the off-rate is slower at acidic pH than at neutral pH. For example, in some embodiments, an Ab specifically binds to a VISTA-ECD protein with a $k_{off}$ rate that is at least 1.5 fold, 2 fold, 5 fold, 10 fold, 20 fold, 50 fold, 100 fold or 1000 fold lower at pH 6.0, relative to pH 7.0 and/or pH 7.4, as measured, e.g., at 25° C. or at 37° C. In certain embodiments, an Ab is provided that binds to the VISTA-ECD protein with a $k_{off}$ that is at least 1.5 fold, 2 fold, 5 fold, 10 fold, 20 fold, 50 fold, 100 fold or 1000 fold lower at pH 6.5 than the $K_{off}$ at pH 7.4, as measured, e.g., at 25° C. or at 37° C. In some embodiments, an Ab specifically binds to a VISTA-ECD protein with a $k_{off}$ rate that is at least 1.5 fold, 2 fold, 5 fold, 10 fold, 20 fold, 50 fold, 100 fold or 1000 fold lower at pH 6.0, relative to pH 7.4, as measured, e.g., at 25° C. or at 37° C. In certain embodiments, an Ab is provided that binds to the VISTA-ECD protein with a $k_{off}$ that is at least 1.5 fold, 2 fold, 5 fold, 10 fold, 20 fold, 50 fold, 100 fold or 1000 fold lower at pH 6.0-6.5 than the $k_{off}$ at pH 7.0-7.4, as measured, e.g., at 25° C. or at 37° C.

In certain embodiments, an Ab that specifically binds to a VISTA-ECD protein with a $k_{on}$ that is higher in acidic conditions relative to neutral, physiological, or alkaline conditions. In certain embodiments, an Ab is provided that binds to a VISTA-ECD protein in acidic conditions with a $k_{on}$ that is at least 2 fold, 5 fold, 10 fold, 20 fold, 50 fold, 100 fold, or 1000 fold higher at pH 6.5 than the $k_{on}$ at pH 7.0 and/or pH 7.4, as measured, e.g., at 25° C. or at 37° C. For example, in some embodiments, an Ab specifically binds to aVISTA-ECD protein with a $k_{on}$ that is at least 2 fold, 5 fold, 10 fold, 20 fold, 50 fold, 100 fold or 1000 fold higher at pH 6.0 than at pH 7.0 and/or pH 7.4, as measured, e.g., at 25° C. or at 37° C.

In certain embodiments, an Ab specifically binds to a VISTA-ECD protein at a pH at which at least one histidine residue, e.g., His 98 in SEQ ID NO: 1, is protonated. In certain embodiments, an Ab specifically binds to a VISTA-ECD protein at a pH at which most histidine residues in the ECD are protonated, which is expected to be pH 6.5 or less, e.g., between pH 6.0 and pH 6.5.

Also encompassed herein are Abs that specifically bind to a VISTA-ECD protein with an affinity that is higher at neutral, physiological, or alkaline pH relative to acidic pH, provided that the affinity of binding at acidic pH remains high. For example, Abs may bind to the VISTA-ECD protein with a $K_D$ of $10^{-8}$ M or less at both pH 6.5 and pH 7.0 even though the Abs bind with a $K_D$ that is at least 1.5 fold, 2 fold, 5 fold, 10 fold, 20 fold, 50 fold, 100 fold, 300 fold, 500 fold, 1000 fold lower at pH 7.0 than at pH 6.5.

Also encompassed herein are Abs that share one or more of the above properties of this section. The above properties, such as particular $K_D$'s, $k_{off}$'s, $k_{on}$'s, specific epitopes are not to be treated in isolation. Thus, an Ab may bind to an epitope comprising one of the regions of SEQ ID NO:2 described above, and also may have pan binding or pH sensitive or pH selective binding properties as described above, as shown by one or more of the behaviors of its $K_D$, $k_{off}$, or $k_{on}$ at different pH's.

In any of the above embodiments, the Ab may be, for example, a full length antibody (i.e., comprising a full length heavy chain (with or without C-terminal lysine) and a full length light chain), or an antigen binding fragment such as a Fab fragment, a Fab' fragment, (Fab')$_2$ fragment, an scFv fragment, an Fv fragment, or the Ab may be a chimeric, humanized, or human antibody, or the Ab may be a bispecific or multispecific antibody.

Determining how well an Ab binds to a VISTA-ECD protein at a given pH can be conducted using several different methods. For example, by surface plasmon resonance (SPR), such as by BIACORE® assays. An exemplary SPR assay comprises capturing one or several antibodies on a CM4 sensor chip with immobilized capture reagent (e.g., using Biacore® anti-human Fc capture kit, GE Healthcare catalog #BR-1008-39, or Biacore® anti-mouse capture kit, GE Healthcare catalog #BR-1008-39), and flowing VISTA antigen as analyte in a concentration series to determine binding kinetics and affinities in a running buffer with desired pH. In one embodiment, VISTA is injected at two to five concentrations in the range of 0.1 nM to 500 nM (e.g., 0.1 nM, 1 nM, 10 nM, 100 nM, 500 nM) with a flow rate of 30 uL/min, up to four minutes association time and up to ten minutes dissociation time. Between binding cycles, the capture surface is regenerated following the manufacturer's instructions for the respective capture kit. All data is double-referenced using a reference flow cell and a blank injection. Data with simple 1:1 kinetics are fitted to a Langmuir binding model with mass transfer using the Biacore® T200 evaluation software. The SPR methods described in the Examples may also be used.

The affinity of an Ab for a VISTA ECD polypeptide may be determined using cells expressing a VISTA ECD polypeptide, PSGL-1 or heparan sulfate on their surface, which method comprises flow cytometry, and wherein binding of an Ab to cell bound VISTA-ECD is determined at a given pH, e.g., pH 6.5 or less. An exemplary flow cytometry assay comprises the following: 293T cells or other cells ectopically expressing hVISTA ECD are re-suspended in a buffer consisting of HBSS+1% BSA adjusted to the desirable pH, e.g., pH 6.0 with MES or pH 7.4 with HEPES. Abs (e.g., human IgG) against hVISTA are serially diluted from approximately 20 μg/mLand incubated with the re-suspended cells for 30 minutes at 4° C. Cells are then washed twice with the same buffers, maintaining the desired pH, e.g., pH at 6.0 or 7.4, and incubated with a fluorophore-conjugated secondary antibody that recognizes the primary antibody (e.g., human IgG) and is stable at reduced pH. Cells are then washed as before and acquired immediately, without fixation, on a BD Fortessa or other flow cytometer. The affinity of an Ab for a VISTA ECD polypeptide may be determined as described in the Examples.

In certain embodiments, Abs that bind to hVISTA ECD block binding of hVISTA to its binding partner (e.g., a VISTA receptor), e.g., on cells. Inhibition or blocking may be 100% or at least 99%, 95%, 90%, 85%, 80%, 75%, or 50%. In certain embodiments, an Ab binds to a VISTA-ECD protein at acidic pH, e.g., pH 6.5 or less, and inhibits binding of VISTA to its binding partner by at least 50%, such as by at least 75%, 80%, 85%, 90%, 95%, or 100%. In certain embodiments, an Ab specifically binds to the VISTA-ECD protein and inhibits binding of VISTA to its binding partner by at least 50% at a pH that is less than pH 7.0. In certain embodiments, an Ab specifically binds to a VISTA-ECD protein and inhibits binding of VISTA to its binding partner by at least 50% at a pH that is less than pH 6.8. In certain embodiments, an Ab specifically binds to a VISTA-ECD protein and inhibits binding of VISTA to its binding partner by at least 50% at a pH that is less than pH 6.5. In certain embodiments, an Ab specifically binds to a VISTA-ECD protein and inhibits binding of VISTA to its binding partner by at least 50% at a pH that is less than pH 6.3. In certain embodiments, an Ab specifically binds to a VISTA-ECD protein and inhibits binding of VISTA to its binding partner by at least 50% at a pH that is less than pH 6.0. In certain embodiments, an Ab specifically binds to a VISTA-ECD protein and inhibits binding of VISTA to its binding partner by at least 50% at a pH that is less than pH 5.8. In certain embodiments, an Ab specifically binds to a VISTA-ECD protein and inhibits binding of VISTA to its binding partner by at least 50% at a pH that is less than pH 5.5. In certain embodiments, an Ab specifically binds to a VISTA-ECD protein and inhibits binding of VISTA to its binding partner by at least 50% at a pH that is less than pH 5.3. In certain embodiments, an Ab specifically binds to a VISTA-ECD protein and inhibits binding of VISTA to its binding partner by at least 50% at a pH that is less than pH 5.0.

Certain Abs specifically bind to a VISTA-ECD protein and inhibits binding of VISTA to its binding partner by at least 50% at a pH within a range of pH 5.0-pH 7.0. Certain Abs specifically bind to a VISTA-ECD protein and inhibits binding of VISTA to its binding partner by at least 50% at a pH within a range of pH 5.0-pH 6.5. Certain Abs specifically bind to a VISTA-ECD protein and inhibits binding of VISTA to its binding partner by at least 50% at a pH within a range of pH 5.0-pH 6.0. Certain Abs specifically bind to a VISTA-ECD protein and inhibits binding of VISTA to its binding partner by at least 50% at a pH within a range of pH 5.5-pH 7.0. Certain Abs specifically bind to a VISTA-ECD protein and inhibits binding of VISTA to its binding partner by at least 50% at a pH within a range of pH 5.5-pH 6.5. Certain Abs specifically bind to a VISTA-ECD protein and inhibits binding of VISTA to its binding partner by at least 50% at a pH within a range of pH 6.0-6.5. Inhibition of binding can be determined as described in the Examples.

A VISTA binding partner may be PSGL-1, such as human PSGL-1. Sequences of human PSGL-1 isoforms are provided as SEQ ID NOs: 3-10 herein. VISTA binds to PSGL-1 with or without siayl lewis X. A binding partner may also be heparan sulfate proteoglycans, e.g., present on certain cells.

Inhibition of binding to a VISTA binding partner can be determined by measuring the inhibition of binding of VISTA (or VISTA ECD or VISTA IgV domain or VISTA positive cells), to cells to which VISTA binds, e.g., T cells (e.g., CD4+ T cells, CD8+ T cells, either activated or not), NK cells, or other cells to which VISTA binds, in the presence and absence of the antibody. An exemplary experiment that can be used to determine if an antibody inhibits the binding of VISTA to its binding partner or T cells expressing a binding partner is a flow cytometry assay, e.g., an assay that comprises the following: human peripheral blood mononuclear cells from donor blood, buffy coat, or leukopak are re-suspended in a buffer consisting of HBSS+1% BSA adjusted to the desirable pH, e.g., pH 6.0 with MES or pH 7.4 with HEPES. The cells are then incubated for 30 minutes at 4° C. with 20 µg/mL recombinant chimeric protein consisting of hVISTA ECD fused to human IgG1 Fc (VISTA-Fc) and with varying concentrations of candidate VISTA blocking antibodies or control antibodies. Cells are then washed twice in the same buffers, maintaining the desired pH, e.g., pH 6.0 or 7.4, and incubated for another 30 minutes at 4° C. with a fluorophore-conjugated secondary antibody that recognizes VISTA-Fc, but not the candidate blocking antibodies or control antibodies, and is stable at reduced pH. Cells are then washed as before and acquired immediately, without fixation, on a BD Fortessa or other flow cytometer. Inhibition of binding can be determined, e.g., as described in the Examples.

In specific embodiments, the Abs described herein may trigger or enhance an immune response, such as an antigen-specific immune response. In certain embodiments, the Abs stimulate T cell activity, particularly at acidic pH such as is found in tumor microenvironments. Stimulation of T cell activity can be measured, e.g., in a mixed lymphocyte reaction (MLR) or in an in vitro assay with an antigen presenting cell (natural or artificial) and T cells. Stimulation of T cell activity can also be measured using, e.g., the Jurkat assay described in the Examples. Stimulation of T cell activity may be measured by determining IFN-γ secretion from T cells, wherein an enhanced IFN-γ secretion indicates T cell stimulation. Secretion of other cytokines from activated T cells may also be measured. In certain embodiments, signal transduction of activated T cells is measured, such as NF-kB levels. In specific embodiments, the Abs described herein inhbit cell adhesion, which can be measured as described in the Examples.

Activity of anti-VISTA Abs can also be shown in monocyte assays, ADCC assays, and ADCP assays, particularly at acidic pH such as is found in tumor microenvironments.

In certain embodiments, anti-VISTA Abs inhibit tumor growth in a tumor model, e.g., a human VISTA knock-in tumor model.

As shown in the Examples herein, recycling of an anti-VISTA Ab in the endosome such as to enhance the pharmacokinetic (PK) properties, i.e., half-life, of the antibody, requires the anti-VISTA antibody to bind to VISTA in acidic conditions. Thus, anti-VISTA Abs that bind at low pH to VISTA, e.g., a pH of 6.5 or lower, as further described herein, are also expected to have a longer acceptable half-life relative to a VISTA antibody that does not bind to VISTA at acidic pH Exemplary hVISTA-ECD Binding Abs Provided herein are Abs that bind preferentially to hVISTA (ECD) at acidic pH (e.g., in acidic conditions) relative to physiological pH or neutral pH.

In certain embodiments, an anti-hVISTA Ab comprises a heavy chain variable region ("VH") comprising VH CDR1, CDR2 and/or CDR3 of any of the anti-hVISTA Abs provided herein. In certain embodiments, an anti-hVISTA Ab comprises a VH comprising the VH CDR1, CDR2 and CDR3 of any of the anti-hVISTA Abs provided herein. In certain embodiments, an anti-hVISTA Ab comprises a VH comprising VH CDR1, CDR2 and/or CDR3 of P1-061029 or P1-061015 or progeny thereof, such as P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075, P1-069077, P1-061015, P1-068736, P1-068738, P1-068740, P1-068742, P1-068744, P1-068766, P1-068748, P1-068750, P1-068752 P1-068754, P1-068761_E55A, P1-068761_H100G, P1-068761_E56N, P1-068761_E55A_E56N, P1-068761_E30D, P1-068761_E30D_E55A, P1-068761_E56N_H100G, P1-068761_E30D_H100G, P1-068761_E30D_E56N, P1-068761_E100fF, P1-068761_E55A_E100fF, P1-068761_H100G_E100fF, P1-068761_E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, P1-068761_E32Y_E100fF, P1-068767_D52N__D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767_E100fF, P1-068767_E30D_E100fF, P1-061029_F100fE_V102D, P1-061029° F.100fE, P1-061029 V102D, P1-061029 Y32E, or P1-061029_Y32E_F100fE. The VH CDR1, CDR2, and CDR3 of each of these species comprise amino acid positions 26-35 (VH CDR1), 50-66 (VH CDR2), and 99-110 (VH CDR3), of the VH sequences for each of the above antibody species provided in the sequence table below. The CDRs are also underlined and in bold on each of the VH sequences for the above antibody species provided in the Sequence Table below.

In certain embodiments, an anti-hVISTA Ab comprises a VLcomprising VL CDR1, CDR2 and CDR3 of any of the anti-hVISTA Abs provided herein. In certain embodiments, an anti-hVISTA Ab comprises a VL comprising VL CDR1, CDR2 and CDR3 of one of P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075, P1-069077, P1-061015, P1-068736, P1-068738, P1-068740, P1-068742, P1-068744, P1-068766, P1-068748, P1-068750, P1-068752 P1-068754, P1-068761_E55A, P1-068761_H100G, P1-068761_E56N, P1-068761_E55A_E56N, P1-068761_E30D, P1-068761_E30D_E55A, P1-068761_E56N_H100G, P1-068761_E30D_H100G, P1-068761_E30D E56N, P1-068761_E100fF, P1-068761_E55A_E100fF, P1-068761_H100G_E100fF, P1-068761_E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, P1-068761_E32Y_E100fF, P1-068767_D52N_D102V, P1-068767_D52N, P1-068767_D52N_E55A, P1-068767_E55A_D102V, P1-068767_D102V, P1-068767_E55A, P1-068767 E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767_E100fF, P1-068767_E30D_E100fF, P1-061029_F100fE_V102D, P1-061029_F100fE, P1-061029_V102D, P1-061029_Y32E, or P1-061029_Y32E_F100fE. The VL CDR1, CDR2, and CDR3 of each of these species comprise amino acid positions 24-35 (VL CDR1), 51-57 (VL CDR2), and 90-98 (VL CDR3), of the VL sequences for each of the above antibody species provided in the Sequence Table below. The CDRs are also underlined and in bold on each of those sequences.

In certain embodiments, an anti-hVISTA Ab comprises a VH comprising VH CDR1, CDR2 and/or CDR3 of any of the anti-hVISTA Abs provided herein and a VL comprising CDR1, CDR2 and/or CDR3 of any of the anti-hVISTA Abs provided herein. In certain embodiments, an anti-hVISTA Ab comprises a VH comprising VH CDR1, CDR2 and CDR3 of any of the anti-hVISTA Abs provided herein and a VL comprising CDR1, CDR2 and CDR3 of any of the anti-hVISTA Abs provided herein. In certain embodiments, an anti-hVISTA Ab comprises a VH comprising VH CDR1, CDR2 and/or CDR3 of P1-061029 or P1-061015 or progeny thereof, such as P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075, P1-069077, P1-061015, P1-068736, P1-068738, P1-068740, P1-068742, P1-068744, P1-068766, P1-068748, P1-068750, P1-068752 P1-068754, P1-068761_E55A, P1-068761_H100G, P1-068761_E56N, P1-068761_E55A_E56N, P1-068761_E30D, P1-068761_E30D_E55A, P1-068761-E56N_H100G, P1-068761_E30D_H100G, P1-068761_E30D_E56N, P1-068761_E100fF, P1-068761_E55A_E100fF, P1-068761_H100G_E100fF, P1-068761_E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, P1-068761_E32Y_E100fF, P1-068767_D52N_D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767_E100fF, P1-068767_E30D_E100fF, P1-061029_F100fE_V102D, P1-061029_F100fE, P1-061029__V102D, P1-061029_Y32E, or P1-061029_Y32E_F100fE and a VL comprising VL CDR1, CDR2 and CDR3 of P1-061029 or P1-061015 or progeny thereof, such as P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075, P1-069077, P1-061015, P1-068736, P1-068738, P1-068740, P1-068742, P1-068744, P1-068766, P1-068748, P1-068750, P1-068752 P1-068754, P1-068761_E55A, P1-0687611H100G, P1-068761_E56N, P1-068761_E55A_E56N, P1-068761_E30D, P1-068761_E30D_E55A, P1-068761_E56N_H100G, P1-068761_E30D_H100G, P1-068761_E30D_E56N, P1-068761_E100fF, P1-068761_E55A_E100fF, P1-068761_H100G_E100fF, P1-068761_E30D E100fF, P1-068761_E56N_E100fF, P1-068761_E32Y, P1-068761_E32Y_E55A, P1-068761_E32Y_E56N, P1-068761_E30D E32Y, P1-068761_E32Y_H100G, P1-068761_E32Y_E100fF, P1-068767_D52N_D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767_E100fF, P1-068767-E30D_E100fF, P1-061029_F100fE_V102D, P1-061029_F100fE, P1-061029_V102D, P1-061029_Y32E, or P1-061029_Y32E_F100fE.

In some embodiments, an anti-hVISTA Ab may comprise:
(a) a VH comprising the amino acid sequence of the VH CDR1, CDR2 and CDR3 of P1-061029 and a VL comprising the VL CDR1, CDR2 and CDR3 of P1-061029;
(b) a VH comprising the amino acid sequence of the VH CDR1, CDR2 and CDR3 of P1-061015 and a VL comprising the VL CDR1, CDR2 and CDR3 of P1-061015;
(c) a VH comprising the amino acid sequence of the VH CDR1, CDR2 and CDR3 of P1-068757 and a VL comprising the VL CDR1, CDR2 and CDR3 of P1-068757;
(d) a VH comprising the amino acid sequence of the VH CDR1, CDR2 and CDR3 of P1-068759 and a VL comprising the VL CDR1, CDR2 and CDR3 of P1-068759;
(e) a VH comprising the amino acid sequence of the VH CDR1, CDR2 and CDR3 of P1-068761 and a VL comprising the VL CDR1, CDR2 and CDR3 of P1-068761;
(f) a VH comprising the amino acid sequence of the VH CDR1, CDR2 and CDR3 of P1-068763 and a VL comprising the VL CDR1, CDR2 and CDR3 of P1-068763;
(g) a VH comprising the amino acid sequence of the VH CDR1, CDR2 and CDR3 of P1-068765 and a VL comprising the VL CDR1, CDR2 and CDR3 of P1-068765;
(h) a VH comprising the amino acid sequence of the VH CDR1, CDR2 and CDR3 of P1-068767 and a VL comprising the VL CDR1, CDR2 and CDR3 of P1-068767;

(i) a VH comprising the amino acid sequence of the VH CDR1, CDR2 and CDR3 of P1-068769 and a VL comprising the VL CDR1, CDR2 and CDR3 of P1-068769;

(j) a VH comprising the amino acid sequence of the VH CDR1, CDR2 and CDR3 of P1-068771 and a VL comprising the VL CDR1, CDR2 and CDR3 of P1-068771;

(k) a VH comprising the amino acid sequence of the VH CDR1, CDR2 and CDR3 of P1-068773 and a VL comprising the VL CDR1, CDR2 and CDR3 of P1-068773;

(l) a VH comprising the amino acid sequence of the VH CDR1, CDR2 and CDR3 of P1-068775 and a VL comprising the VL CDR1, CDR2 and CDR3 of P1-068775;

(m) a VH comprising the amino acid sequence of the VH CDR1, CDR2 and CDR3 of P1-069059 and a VL comprising the VL CDR1, CDR2 and CDR3 of P1-069059;

(n) a VH comprising the amino acid sequence of the VH CDR1, CDR2 and CDR3 of P1-069061 and a VL comprising the VL CDR1, CDR2 and CDR3 of P1-069061;

(o) a VH comprising the amino acid sequence of the VH CDR1, CDR2 and CDR3 of P1-069063 and a VL comprising the VL CDR1, CDR2 and CDR3 of P1-069063;

(p) a VH comprising the amino acid sequence of the VH CDR1, CDR2 and CDR3 of P1-069065 and a VL comprising the VL CDR1, CDR2 and CDR3 of P1-069065;

(q) a VH comprising the amino acid sequence of the VH CDR1, CDR2 and CDR3 of P1-069067 and a VL comprising the VL CDR1, CDR2 and CDR3 of P1-069067;

(r) a VH comprising the amino acid sequence of the VH CDR1, CDR2 and CDR3 of P1-069069 and a VL comprising the VL CDR1, CDR2 and CDR3 of P1-069069;

(s) a VH comprising the amino acid sequence of the VH CDR1, CDR2 and CDR3 of P1-069071 and a VL comprising the VL CDR1, CDR2 and CDR3 of P1-069071;

(t) a VH comprising the amino acid sequence of the VH CDR1, CDR2 and CDR3 of P1-069073 and a VL comprising the VL CDR1, CDR2 and CDR3 of P1-069073;

(u) a VH comprising the amino acid sequence of the VH CDR1, CDR2 and CDR3 of P1-069075 and a VL comprising the VL CDR1, CDR2 and CDR3 of P1-069075;

(v) a VH comprising the amino acid sequence of the VH CDR1, CDR2 and CDR3 of P1-069077 and a VL comprising the VL CDR1, CDR2 and CDR3 of P1-069077;

(w) a VH comprising the amino acid sequence of the VH CDR1, CDR2 and CDR3 of P1-068736 and a VL comprising the VL CDR1, CDR2 and CDR3 of P1-068736;

(x) a VH comprising the amino acid sequence of the VH CDR1, CDR2 and CDR3 of P1-068738 and a VL comprising the VL CDR1, CDR2 and CDR3 of P1-068738;

(y) a VH comprising the amino acid sequence of the VH CDR1, CDR2 and CDR3 of P1-068740 and a VL comprising the VL CDR1, CDR2 and CDR3 of P1-068740;

(z) a VH comprising the amino acid sequence of the VH CDR1, CDR2 and CDR3 of P1-068742 and a VL comprising the VL CDR1, CDR2 and CDR3 of P1-068742;

(aa) a VH comprising the amino acid sequence of the VH CDR1, CDR2 and CDR3 of P1-068744 and a VL comprising the VL CDR1, CDR2 and CDR3 of P1-068744;

(bb) a VH comprising the amino acid sequence of the VH CDR1, CDR2 and CDR3 of P1-068746 and a VL comprising the VL CDR1, CDR2 and CDR3 of P1-068746;

(cc) a VH comprising the amino acid sequence of the VH CDR1, CDR2 and CDR3 of P1-068748 and a VL comprising the VL CDR1, CDR2 and CDR3 of P1-068748;

(dd) a VH comprising the amino acid sequence of the VH CDR1, CDR2 and CDR3 of P1-068750 and a VL comprising the VL CDR1, CDR2 and CDR3 of P1-068750;

(ee) a VH comprising the amino acid sequence of the VH CDR1, CDR2 and CDR3 of P1-068752 and a VL comprising the VL CDR1, CDR2 and CDR3 of P1-068752;

(ff) a VH comprising the amino acid sequence of the VH CDR1, CDR2 and CDR3 of P1-068754 and a VL comprising the VL CDR1, CDR2 and CDR3 of P1-068754;

(gg) a VH comprising the amino acid sequence of the VH CDR1, CDR2 and CDR3 of P1-068761_E55A and a VL comprising the VL CDR1, CDR2 and CDR3 of P1-068761_E55A;

(hh) a VH comprising the amino acid sequence of the VH CDR1, CDR2 and CDR3 of P1-068761_H100G and a VL comprising the VL CDR1, CDR2 and CDR3 of P1-068761_H100G;

(ii) a VH comprising the amino acid sequence of the VH CDR1, CDR2 and CDR3 of P1-068761_E56N and a VL comprising the VL CDR1, CDR2 and CDR3 of P1-068761_E56N;

(jj) a VH comprising the amino acid sequence of the VH CDR1, CDR2 and CDR3 of P1-068761_E55A_E56N and a VL comprising the VL CDR1, CDR2 and CDR3 of P1-068761_E55A_E56N;

(kk) a VH comprising the amino acid sequence of the VH CDR1, CDR2 and CDR3 of P1-068761_E30D and a VL comprising the VL CDR1, CDR2 and CDR3 of P1-068761_E30D;

(ll) a VH comprising the amino acid sequence of the VH CDR1, CDR2 and CDR3 of P1-068761_E30D_E55A and a VL comprising the VL CDR1, CDR2 and CDR3 of P1-068761_E30D_E55A;

(mm) a VH comprising the amino acid sequence of the VH CDR1, CDR2 and CDR3 of P1-068761_E56N_H100G and a VL comprising the VL CDR1, CDR2 and CDR3 of P1-068761_E56N_H100G;

(nn) a VH comprising the amino acid sequence of the VH CDR1, CDR2 and CDR3 of P1-068761_E30D_H100G and a VL comprising the VL CDR1, CDR2 and CDR3 of P1-068761_E30D_H100G;

(oo) a VH comprising the amino acid sequence of the VH CDR1, CDR2 and CDR3 of P1-068761_E30D_E56N and a VL comprising the VL CDR1, CDR2 and CDR3 of P1-068761_E30D_E56N;
(pp) a VH comprising the amino acid sequence of the VH CDR1, CDR2 and CDR3 of P1-068761_E100fF and a VL comprising the VL CDR1, CDR2 and CDR3 of P1-068761_E100fF;
(qq) a VH comprising the amino acid sequence of the VH CDR1, CDR2 and CDR3 of P1-068761_E55A_E100fF and a VL comprising the VL CDR1, CDR2 and CDR3 of P1-068761_E55A-E100fF;
(rr) a VH comprising the amino acid sequence of the VH CDR1, CDR2 and CDR3 of P1-068761_H100G_E100fF and a VL comprising the VL CDR1, CDR2 and CDR3 of P1-068761 H100G_E100fF;
(ss) a VH comprising the amino acid sequence of the VH CDR1, CDR2 and CDR3 of P1-068761_E30D_E100fF and a VL comprising the VL CDR1, CDR2 and CDR3 of P1-068761_E30D_E100fF;
(tt) a VH comprising the amino acid sequence of the VH CDR1, CDR2 and CDR3 of P1-068761_E56N_E100fF and a VL comprising the VL CDR1, CDR2 and CDR3 of P1-068761_E56N_E100fF;
(uu) a VH comprising the amino acid sequence of the VH CDR1, CDR2 and CDR3 of P1-068761_E32Y and a VL comprising the VL CDR1, CDR2 and CDR3 of P1-068761_E32Y;
(vv) a VH comprising the amino acid sequence of the VH CDR1, CDR2 and CDR3 of P1-068761_E32Y_E55A and a VL comprising the VL CDR1, CDR2 and CDR3 of P1-068761_E32Y_E55A;
(ww) a VH comprising the amino acid sequence of the VH CDR1, CDR2 and CDR3 of P1-068761_E32Y_E56N and a VL comprising the VL CDR1, CDR2 and CDR3 of P1-068761_E32Y_E56N;
(xx) a VH comprising the amino acid sequence of the VH CDR1, CDR2 and CDR3 of P1-068761_E30D_E32Y and a VL comprising the VL CDR1, CDR2 and CDR3 of P1-068761_E30D_E32Y;
(yy) a VH comprising the amino acid sequence of the VH CDR1, CDR2 and CDR3 of P1-068761_E32Y_H100G and a VL comprising the VL CDR1, CDR2 and CDR3 of P1-068761_E32Y_H100G;
(zz) a VH comprising the amino acid sequence of the VH CDR1, CDR2 and CDR3 of P1-068761_E32Y_E100fF and a VL comprising the VL CDR1, CDR2 and CDR3 of P1-068761_E32Y_E100fF;
(aaa) a VH comprising the amino acid sequence of the VH CDR1, CDR2 and CDR3 of P1-068767_D52N_D102V and a VL comprising the VL CDR1, CDR2 and CDR3 of P1-068767_D52N_D102V;
(bbb) a VH comprising the amino acid sequence of the VH CDR1, CDR2 and CDR3 of P1-068767_D52N and a VL comprising the VL CDR1, CDR2 and CDR3 of P1-068767_D52N;
(ccc) a VH comprising the amino acid sequence of the VH CDR1, CDR2 and CDR3 of P1-068767_D52N_E55A and a VL comprising the VL CDR1, CDR2 and CDR3 of P1-068767_D52N_E55A;
(ddd) a VH comprising the amino acid sequence of the VH CDR1, CDR2 and CDR3 of P1-068767_E55A_D102V and a VL comprising the VL CDR1, CDR2 and CDR3 of P1-068767_E55A_D102V;
(eee) a VH comprising the amino acid sequence of the VH CDR1, CDR2 and CDR3 of P1-068767 D102V and a VL comprising the VL CDR1, CDR2 and CDR3 of P1-068767_D102V;
(fff) a VH comprising the amino acid sequence of the VH CDR1, CDR2 and CDR3 of P1-068767_E55A and a VL comprising the VL CDR1, CDR2 and CDR3 of P1-068767_E55A;
(ggg) a VH comprising the amino acid sequence of the VH CDR1, CDR2 and CDR3 of P1-068767_E30D_D52N and a VL comprising the VL CDR1, CDR2 and CDR3 of P1-068767_E30D_D52N;
(hhh) a VH comprising the amino acid sequence of the VH CDR1, CDR2 and CDR3 of P1-068767_E30D_D102V and a VL comprising the VL CDR1, CDR2 and CDR3 of P1-068767_E30D_D102V;
(iii) a VH comprising the amino acid sequence of the VH CDR1, CDR2 and CDR3 of P1-068767_E30D and a VL comprising the VL CDR1, CDR2 and CDR3 of P1-068767_E30D;
(jjj) a VH comprising the amino acid sequence of the VH CDR1, CDR2 and CDR3 of P1-068767_E30D_E55A and a VL comprising the VL CDR1, CDR2 and CDR3 of P1-068767_E30D_E55A;
(kkk) a VH comprising the amino acid sequence of the VH CDR1, CDR2 and CDR3 of P1-068767_E100fF_D102V and a VL comprising the VL CDR1, CDR2 and CDR3 of P1-068767 E100fF_D102V;
(lll) a VH comprising the amino acid sequence of the VH CDR1, CDR2 and CDR3 of P1-068767_E55A_E100fF and a VL comprising the VL CDR1, CDR2 and CDR3 of P1-068767 E55A_E100fF;
(mmm) a VH comprising the amino acid sequence of the VH CDR1, CDR2 and CDR3 of P1-068767_D52N_E100fF and a VL comprising the VL CDR1, CDR2 and CDR3 of P1-068767_D52N_E100fF;
(nnn) a VH comprising the amino acid sequence of the VH CDR1, CDR2 and CDR3 of P1-068767_E100fF and a VL comprising the VL CDR1, CDR2 and CDR3 of P1-068767_E100fF;
(ooo) a VH comprising the amino acid sequence of the VH CDR1, CDR2 and CDR3 of P1-068767_E30D-E100fF and a VL comprising the VL CDR1, CDR2 and CDR3 of P1-068767_E30D-E100fF;
(ppp) a VH comprising the amino acid sequence of the VH CDR1, CDR2 and CDR3 of P1-061029_F100fE_V102D and a VL comprising the VL CDR1, CDR2 and CDR3 of P1-061029_F100fE_V102D;
(qqq) a VH comprising the amino acid sequence of the VH CDR1, CDR2 and CDR3 of P1-061029_F00fE and a VL comprising the VL CDR1, CDR2 and CDR3 of P1-061029° F.100fE;
(rrr) a VH comprising the amino acid sequence of the VH CDR1, CDR2 and CDR3 of P1-061029_V102D and a VL comprising the VL CDR1, CDR2 and CDR3 of P1-061029_V102D;
(sss) a VH comprising the amino acid sequence of the VH CDR1, CDR2 and CDR3 of P1-061029_Y32E and a VL comprising the VL CDR1, CDR2 and CDR3 of P1-061029_Y32E; or
(ttt) a VH comprising the amino acid sequence of the VH CDR1, CDR2 and CDR3 of P1-061029_Y32E_F100fE and a VL comprising the VL CDR1, CDR2 and CDR3 of P1-061029_Y32E_F100fE.

Again, the Sequence Table below provides the heavy and light chain variable region sequences and full length heavy and light chain sequences of the antibodies listed above with an IgG1.3 heavy chain constant region (unless a different HC constant region is noted in the table) and notes the locations of their VH CDR1, CDR2, and CDR3 and VL CDR1, CDR2, and CDR3 by amino acid residue and with bolding and underlining of the CDRs in each VH and VL sequence. Thus, for example, VH CDR1 of P1-061029 comprises amino acids 26-35 of SEQ ID NO: 67, while VH CDR2 comprises amino acids 50-66 of SEQ ID NO: 67, and VH CDR3 comprises amino acids 99-110 of SEQ ID NO: 67, and so forth, as noted by the bolded and underlined amino acids of SEQ ID NO: 67 shown in the Sequence Table.

In certain embodiments, an anti-hVISTA Ab comprises a VH comprising the amino acid sequence of the VH of any of the anti-hVISTA Abs provided herein. The individual VH sequences for particular antibody species provided herein are listed in the Sequence Table. In certain embodiments, an anti-hVISTA Ab comprises a VH comprising the amino acid sequence of the VH of P1-061029 or P1-061015 or progeny thereof, such as P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075, P1-069077, P1-061015, P1-068736, P1-068738, P1-068740, P1-068742, P1-068744, P1-068766, P1-068748, P1-068750, P1-068752 P1-068754, P1-068761_E55A, P1-068761_H100G, P1-068761_E56N, P1-068761_E55A_E56N, P1-068761_E30D, P1-068761_E30D_E55A, P1-068761_E56N_H100G, P1-068761_E30D_H100G, P1-068761_E30D_E56N, P1-068761_E100fF, P1-068761_E55A_E100fF, P1-068761_H100G_E100fF, P1-068761_E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, P1-068761_E32Y_E100fF, P1-068767 D52N_D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767_E100fF, P1-068767_E30D_E100fF, P1-061029_F100fE_V102D, P1-061029_F100fE, P1-061029_V102D, P1-061029_Y32E, or P1-061029_Y32E_F100fE.

In some embodiments, an anti-hVISTA Ab comprises the VH of any of antibodies P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075, P1-069077, P1-061015, P1-068736, P1-068738, P1-068740, P1-068742, P1-068744, P1-068766, P1-068748, P1-068750, P1-068752 P1-068754, P1-068761_E55A, P1-068761_H100G, P1-068761_E56N, P1-068761_E55A_E56N, P1-068761_E30D, P1-068761_E30D_E55A, P1-068761_E56N_H100G, P1-068761_E30D_JJ100G, P1-068761_E30D_E56N, P1-068761_E100fF, P1-068761_E55A_E100fF, P1-068761_H100G_E100fF, P1-068761_E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, P1-068761_E32Y_E100fF, P1-068767_D52N_D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767 E30D, P1-068767_E30D_E55A, P1-068767-E100fF_D102V, P1-068767_E55A_E100fF, P1-068767_D52N_E100fF, P1-068767_E100fF, P1-068767_E30D_E100fF, P1-061029_F100fE_V102D, P1-061029_F100fE, P1-061029_V102D, P1-061029_Y32E, or P1-061029_Y32E_F100fE, but with 1, 2, 3, 4, or 5 amino acid substitutions in the framework regions of the VH sequence, such as 1, 2, 3, 4, or 5 conservative substitutions. In some embodiments, an anti-hVISTA Ab comprises the VH of any of antibodies P1-061029 or its progeny such as, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075, P1-069077, P1-068766, P1-068761_E55A, P1-068761_H100G, P1-068761_E56N, P1-068761_E55A_E56N, P1-068761_E30D, P1-068761_E30D_E55A, P1-068761_E56N_H100G, P1-068761_E30D__H100G, P1-068761_E30D E56N, P1-068761_E100fF, P1-068761_E55A_E100fF, P1-068761_H100G_E100fF, P1-068761_E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, P1-068761_E32Y_E100fF, P1-068767_D52N_D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767 E30D, P1-068767_E30D_E55A, P1-068767-E100fF_D102V, P1-068767_E55A_E100fF, P1-068767_D52N_E100fF, P1-068767_E100fF, P1-068767_E30D_E100fF, P1-061029_F100fE_V102D, P1-061029_F100fE, P1-061029_V102D, P1-061029_Y32E, or P1-061029_Y32E_F100fE, but with one or more germline reversion substitutions, e.g., one or both of K16R and/or T84A substitutions, in the framework regions of the VH sequences shown in the Sequence Table. Exemplary VH sequences with such amino acid substitutions are provided in the Sequence Table with residues 16 and 84 highlighted in bold and underlined. Note that P1-061015 contains R at position 16 and A at position 84 of its VH framework regions.

In certain embodiments, an anti-hVISTA Ab comprises a VH CDR1, CDR2, and CDR3 comprising the amino acid sequences of the VH CDRs of any of the anti-hVISTA Abs provided herein and comprises a VH that is at least 90%, at least 91%, at least 92%, at least 93%, at least 94%, at least 95%, at least 96%, at least 97%, at least 98%, or at least 99% identical to the VH of any of the anti-hVISTA Abs provided herein. In certain embodiments, an anti-hVISTA Ab comprises a VH comprising an amino acid sequence that is at least 90%, at least 91%, at least 92%, at least 93%, at least 94%, at least 95%, at least 96%, at least 97%, at least 98%, or at least 99% identical to the amino acid sequence of the VH of P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075, P1-069077,P1-061015,P1-068736, P1-068738, P1-068740, P1-068742, P1-068744, P1-068766, P1-068748, P1-068750, P1-068752 P1-068754, P1-068761_E55A, P1-068761_H100G, P1-068761_E56N, P1-068761_E55A_E56N, P1-068761_E30D, P1-068761_E30D_E55A, P1-068761_E56N_H100G, P1-068761_E30D_H100G, P1-068761_E30D_E56N, P1-068761_E100fF, P1-068761_E55A_E100fF, P1-068761_H100G_E100fF, P1-068761_E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, P1-068761_E32Y_E100fF, P1-068767_D52N_D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767_E100fF, P1-068767_E30D_E100fF, P1-061029_F100fE_V102D, P1-061029_F100fE, P1-061029_V102D, P1-061029_Y32E, or P1-061029_Y32E_F100fE. In certain embodiments, the VH of the antibody differs from that of the VH sequences shown in the Sequence Table due to 1, 2, 3, 4, or 5 amino acid substitutions in the framework regions of the VH sequence, such as 1, 2, 3, 4, or 5 conservative substitutions, or such as one or both of K16R and/or T84A substitutions in P1-061029 or its progeny.

In certain embodiments, an anti-hVISTA Ab comprises a VH consisting of the amino acid sequence of the VH of any of the anti-hVISTA Abs provided herein. In certain embodiments, an anti-hVISTA Ab comprises a VH that consists of the amino acid sequence of the VH of P1-061029 or P1-061015 or progeny thereof, such as P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075, P1-069077, P1-061015, P1-068736, P1-068738, P1-068740, P1-068742, P1-068744, P1-068766, P1-068748, P1-068750, P1-068752 P1-068754, P1-068761_E55A, P1-068761_H100G, P1-068761_E56N, P1-068761_E55A_E56N, P1-068761_E30D, P1-068761_E30D_E55A, P1-068761_E56N_H100G, P1-068761_E30D_H100G, P1-068761_E30D_E56N, P1-068761_E100fF, P1-068761_E55A_E100fF, P1-068761_H100G_E100fF, P1-068761_E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, P1-068761_E32Y_E100fF, P1-068767_D52N_D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767_E100fF, P1-068767_E30D_E100fF, P1-061029_F100fE_V102D, P1-061029_F100fE, P1-061029_V102D, P1-061029_Y32E, or P1-061029_Y32E_F100fE optionally with one or both of K16R and/or T84A substitutions.

In certain embodiments, an anti-hVISTA Ab comprises a VL comprising the amino acid sequence of the VL of any of the anti-hVISTA Abs provided herein. In certain embodiments, an anti-hVISTA Ab comprises a VL comprising the amino acid sequence of the VL of P1-061029 or P1-061015 or progeny thereof, such as P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075, P1-069077, P1-061015, P1-068736, P1-068738, P1-068740, P1-068742, P1-068744, P1-068766, P1-068748, P1-068750, P1-068752 P1-068754, P1-068761_E55A, P1-068761_H100G, P1-068761_E56N, P1-068761_E55A_E56N, P1-068761_E30D, P1-068761_E30D_E55A, P1-068761_E56N_H100G, P1-068761_E30D_H100G, P1-068761_E30D_E56N, P1-068761_E100fF, P1-068761_E55A_E100fF, P1-068761_H100G_E100fF, P1-068761_E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, P1-068761_E32Y_E100fF, P1-068767_D52N_D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767_E100fF, P1-068767_E30D_E100fF, P1-061029_F100fE_V102D, P1-061029_F100fE, P1-061029_V102D, P1-061029 Y32E, or P1-061029 Y32E_F100fE. In certain embodiments, an anti-hVISTA Ab comprises a VL CDR1, CDR2, and CDR3 comprising the amino acid sequences of the VL CDRs of any of the anti-hVISTA Abs provided herein and comprises a VL that is at least 90%, at least 91%, at least 92%, at least 93%, at least 94%, at least 95%, at least 96%, at least 97%, at least 98%, or at least 99% identical to the VL of any of the anti-hVISTA Abs provided herein. In certain embodiments, an anti-hVISTA Ab comprises a VL comprising an amino acid sequence that is at least 90%, at least 91%, at least 92%, at least 93%, at least 94%, at least 95%, at least 96%, at least 97%, at least 98%, or at least 99% identical to the amino acid sequence of the VL of P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075, P1-069077, P1-061015, P1-068736, P1-068738, P1-068740, P1-068742, P1-068744, P1-068766, P1-068748, P1-068750, P1-068752 P1-068754, P1-068761_E55A, P1-068761_H100G, P1-068761_E56N, P1-068761_E55A_E56N, P1-068761_E30D, P1-068761_E30D_E55A, P1-068761_E56N_H100G, P1-068761_E30D_H100G, P1-068761_E30D_E56N, P1-068761_E100fF, P1-068761_E55A_E100fF, P1-068761_H100G_E100fF, P1-068761_E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, P1-068761_E32Y_E100fF, P1-068767_D52N_D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767_E100fF, P1-068767_E30D_E100fF, P1-061029_F100fE_V102D, P1-061029_F100fE, P1-061029_V102D, P1-061029 Y32E, or P1-061029 Y32E_F100fE. In certain embodiments, the VL of the antibody differs from that of the VL sequences shown in the Sequence Table due to 1, 2, 3, 4, or 5 amino acid substitutions in the framework regions of the VL sequence, such as 1, 2, 3, 4, or 5 conservative substitutions.

In certain embodiments, an anti-hVISTA Ab comprises a VL consisting of the amino acid sequence of the VL of any of the anti-hVISTA Abs provided herein. In certain embodiments, an anti-hVISTA Ab comprises a VL that consists of the amino acid sequence of the VL of P1-061029 or P1-061015 or progeny thereof, such as P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075, P1-069077, P1-061015, P1-068736, P1-068738, P1-068740, P1-068742, P1-068744, P1-068766, P1-068748, P1-068750, P1-068752 P1-068754, P1-068761_E55A, P1-068761_H100G, P1-068761_E56N, P1-068761_E55A_E56N, P1-068761_E30D, P1-068761_E30D_E55A, P1-068761_E56N_H100G, P1-068761_E30D_H100G, P1-068761_E30D_E56N, P1-068761_E100fF, P1-068761_E55A_E100fF, P1-068761_H100G_E100fF, P1-068761_E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, P1-068761_E32Y_E100fF, P1-068767_D52N_D102V, P1-068767_D52N, P1-068767_D52N_E55A, P1-068767_E55A_D102V, P1-068767_D102V, P1-068767_E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767_E100fF, P1-068767_E30D_E100fF, P1-061029_F100fE_V102D, P1-061029_F100fE, P1-061029_V102D, P1-061029_Y32E, or P1-061029_Y32E_F100fE.

In certain embodiments, an anti-hVISTA Ab comprises a VH comprising the amino acid sequence of the VH of any of the anti-hVISTA Abs provided herein and comprises a VL comprising the amino acid sequence of the VL of any of the anti-hVISTA Abs provided herein. In certain of these embodiments, an anti-hVISTA Ab comprises a VH comprising the amino acid sequence of the VH of P1-061029 or P1-061015 or progeny thereof, such as P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075, P1-069077, P1-061015, P1-068736, P1-068738, P1-068740, P1-068742, P1-068744, P1-068766, P1-068748, P1-068750, P1-068752 P1-068754, P1-068761_E55A, P1-068761_H100G, P1-068761_E56N, P1-068761_E55A_E56N, P1-068761_E30D, P1-068761_E30D_E55A, P1-068761_E56N_H100G, P1-068761_E30D_H100G, P1-068761_E30D_E56N, P1-068761_E100fF, P1-068761_E55A_E100fF, P1-068761_H100G_EL100fF, P1-068761_E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, P1-068761_E32Y_E100fF, P1-068767_D52N_D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767_E100fF, P1-068767_E30D_E100fF, P1-061029_F100fE_V102D, P1-061029_F100fE, P1-061029_V102D, P1-061029_Y32E, or P1-061029_Y32E_F100fE; and a VL comprising the amino acid sequence of the VL of P1-061029 or P1-061015.

In certain embodiments, however, the VH of the antibody is that of P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075, P1-069077, P1-061015, P1-068736, P1-068738, P1-068740, P1-068742, P1-068744, P1-068766, P1-068748, P1-068750, P1-068752 P1-068754, P1-068761_E55A, P1-068761_H100G, P1-068761_E56N, P1-068761_E55A_E56N, P1-068761_E30D, P1-068761_E30D_E55A, P1-068761_E56N_H100G, P1-068761_E30D_H100G, P1-068761_E30D_E56N, P1-068761_E100fF, P1-068761_E55A_E100fF, P1-068761_H100G_E100fF, P1-068761_E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, P1-068761_E32Y_E100fF, P1-068767_D52N_D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767_E100fF, P1-068767 E30D_E100fF, P1-061029_F100fE_V102D, P1-061029_F100fE, P1-061029_V102D, P1-061029_Y32E, or P1-061029_Y32E_F100fE, but with 1, 2, 3, 4, or 5 amino acid substitutions in the framework regions of the VH sequence, such as 1, 2, 3, 4, or 5 conservative substitutions, and the VL is that of P1-061029 or P1-061015. In certain embodiments, however, the VH of the antibody is that of P1-061029 or its progeny such as P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075, P1-069077, P1-068766, P1-068761_E55A, P1-068761_H100G, P1-068761_E56N, P1-068761_E55A_E56N, P1-068761_E30D, P1-068761_E30D_E55A, P1-068761_E56N_H100G, P1-068761_E30D_H100G, P1-068761_E30D_E56N, P1-068761_E100fF, P1-068761_E55A_E100fF, P1-068761_H100G_E100fF, P1-068761_E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, P1-068761_E32Y_E100fF, P1-068767_D52N_D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767_E100fF, P1-068767_E30D_E100fF, P1-061029_F100fE_V102D, P1-061029_F100fE, P1-061029_V102D, P1-061029_Y32E, or P1-061029_Y32E_F100fE, but with one or both of a K16R or T84A substitution, and the VL is that of P1-061029 or P1-061015.

In certain embodiments, an anti-hVISTA Ab comprises a VH and a VL comprising the amino acid sequences of the VH and VL of P1-061029 or P1-061015 or progeny thereof, such as P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075, P1-069077, P1-061015, P1-068736, P1-068738, P1-068740, P1-068742, P1-068744, P1-068766, P1-068748, P1-068750, P1-068752 P1-068754, P1-068761_E55A, P1-068761_H100G, P1-068761_E56N, P1-068761_E55A_E56N, P1-068761_E30D, P1-068761_E30D_E55A, P1-068761_E56N_H100G, P1-068761_E30D_H100G, P1-068761_E30D_E56N, P1-068761_E100fF, P1-068761_E55A_E100fF, P1-068761_H100G_E100fF, P1-068761_E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, P1-068761_E32Y_E100fF, P1-068767_D52N_D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767_E100fF, P1-068767_E30D_E100fF, P1-061029_F100fE_V102D, P1-061029_F100fE, P1-061029_V102D, P1-061029_Y32E, or P1-061029_Y32E_F100fE, and optionally, wherein the VH comprises one or both of K16R and/or T84A substitutions.

In certain embodiments, an anti-hVISTA Ab comprises a VH CDR1, CDR2, and CDR3 comprising the amino acid sequences of the VH CDRs of any of the anti-hVISTA Abs provided herein as well as a VL CDR1, CDR2, and CDR3 comprising the amino acid sequences of the VL CDRs of any of the anti-hVISTA Abs provided herein, and also comprises a VH and a VL that are each at least 90%, at least 91%, at least 92%, at least 93%, at least 94%, at least 95%, at least 96%, at least 97%, at least 98%, or at least 99% identical to the corresponding VH and VL of any of the anti-hVISTA Abs provided herein. In certain embodiments, the VH and the VL of the antibody differ from the VH and VL sequences shown in the Sequence Table due to 1, 2, 3, 4, or 5 amino acid substitutions in the framework regions of the sequences, such as 1, 2, 3, 4, or 5 conservative substitutions, or such as one or both of K16R and/or T84A substitutions in the VH sequence.

In certain embodiments, an anti-hVISTA Ab comprises a VH and a VL consisting of the amino acid sequence of the VH and VL of any of the anti-hVISTA Abs provided herein. In certain embodiments, an anti-hVISTA Ab comprises a VH and a VL that each consist of the amino acid sequences of the VH and VL of P1-061029 or P1-061015 or progeny thereof, such as P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075, P1-069077, P1-061015, P1-068736, P1-068738, P1-068740, P1-068742, P1-068744, P1-068766, P1-068748, P1-068750, P1-068752 P1-068754, P1-068761_E55A, P1-068761 H100G, P1-068761_E56N, P1-068761_E55A_E56N, P1-068761_E30D, P1-068761_E30D_E55A, P1-068761_E56N_H100G, P1-068761_E30D_H100G, P1-068761_E30D_E56N, P1-068761_E100fF, P1-068761_E55A_E100fF, P1-068761_H100G_E100fF, P1-068761_E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, P1-068761_E32Y_E100fF, P1-068767_D52N_D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767_E100fF, P1-068767_E30D_E100fF, P1-061029_F100fE_V102D, P1-061029_F100fE, P1-061029_V102D, P1-061029_Y32E, or P1-061029_Y32E_F100fE, and optionally, wherein the VH comprises one or both of K16R and/or T84A substitutions.

An anti-hVISTA Ab may comprise:

(a) a VH comprising the amino acid sequence of the VH of P1-061029 and a VL comprising the amino acid sequence of the VL of P1-061029;

(b) a VH comprising the amino acid sequence of the VH of P1-061015 and a VL comprising the amino acid sequence of the VL of P1-061015;

(c) a VH comprising the amino acid sequence of the VH of P1-068757 and a VL comprising the amino acid sequence of the VL of P1-068757;

(d) a VH comprising the amino acid sequence of the VH of P1-068759 and a VL comprising the amino acid sequence of the VL of P1-068759;

(e) a VH comprising the amino acid sequence of the VH of P1-068761 and a VL comprising the amino acid sequence of the VL of P1-068761;

(f) a VH comprising the amino acid sequence of the VH of P1-068763 and a VL comprising the amino acid sequence of the VL of P1-068763;

(g) a VH comprising the amino acid sequence of the VH of P1-068765 and a VL comprising the amino acid sequence of the VL of P1-068765;

(h) a VH comprising the amino acid sequence of the VH of P1-068767 and a VL comprising the amino acid sequence of the VL of P1-068767;

(i) a VH comprising the amino acid sequence of the VH of P1-068769 and a VL comprising the amino acid sequence of the VL of P1-068769;

(j) a VH comprising the amino acid sequence of the VH of P1-068771 and a VL comprising the amino acid sequence of the VL of P1-068771;

(k) a VH comprising the amino acid sequence of the VH of P1-068773 and a VL comprising the amino acid sequence of the VL of -068773;

(l) a VH comprising the amino acid sequence of the VH of P1-068775 and a VL comprising the amino acid sequence of the VL of P1-068775;

(m) a VH comprising the amino acid sequence of the VH of P1-069059 and a VL comprising the amino acid sequence of the VL of P1-069059;

(n) a VH comprising the amino acid sequence of the VH of P1-069061 and a VL comprising the amino acid sequence of the VL of P1-069061;

(o) a VH comprising the amino acid sequence of the VH of P1-069063 and a VL comprising the amino acid sequence of the VL of P1-069063;

(p) a VH comprising the amino acid sequence of the VH of P1-069065 and a VL comprising the amino acid sequence of the VL of P1-069065;

(q) a VH comprising the amino acid sequence of the VH of P1-069067 and a VL comprising the amino acid sequence of the VL of P1-069067;

(r) a VH comprising the amino acid sequence of the VH of P1-069069 and a VL comprising the amino acid sequence of the VL of P1-069069;

(s) a VH comprising the amino acid sequence of the VH of P1-069071 and a VL comprising the amino acid sequence of the VL of P1-069071;

(t) a VH comprising the amino acid sequence of the VH of P1-069073 and a VL comprising the amino acid sequence of the VL of P1-069073;
(u) a VH comprising the amino acid sequence of the VH of P1-069075 and a VL comprising the amino acid sequence of the VL of P1-069075;
(v) a VH comprising the amino acid sequence of the VH of P1-069077 and a VL comprising the amino acid sequence of the VL of P1-069077;
(w) a VH comprising the amino acid sequence of the VH of P1-068736 and a VL comprising the amino acid sequence of the VL of P1-068736;
(x) a VH comprising the amino acid sequence of the VH of P1-068738 and a VL comprising the amino acid sequence of the VL of P1-068738;
(y) a VH comprising the amino acid sequence of the VH of P1-068740 and a VL comprising the amino acid sequence of the VL of P1-068740;
(z) a VH comprising the amino acid sequence of the VH of P1-068742 and a VL comprising the amino acid sequence of the VL of P1-068742;
(aa) a VH comprising the amino acid sequence of the VH of P1-068744 and a VL comprising the amino acid sequence of the VL of P1-068744;
(bb) a VH comprising the amino acid sequence of the VH f P1-068746 and a VL comprising the amino acid sequence of the VL of P1-068746;
(cc) a VH comprising the amino acid sequence of the VH of P1-068748 and a VL comprising the amino acid sequence of the VL of P1-068748;
(dd) a VH comprising the amino acid sequence of the VH of P1-068750 and a VL comprising the amino acid sequence of the VL of P1-068750;
(ee) a VH comprising the amino acid sequence of the VH of P1-068752 and a VL comprising the amino acid sequence of the VL of P1-068752;
(ff) a VH comprising the amino acid sequence of the VH of P1-068754 and a VL comprising the amino acid sequence of the VL of P1-068754;
(gg) a VH comprising the amino acid sequence of the VH of P1-068761_E55A and a VL comprising the amino acid sequence of the VL of P1-068761_E55A;
(hh) a VH comprising the amino acid sequence of the VH of P1-068761_H100G and a VL comprising the amino acid sequence of the VL of P1-068761 H100G;
(ii) a VH comprising the amino acid sequence of the VH of P1-068761_E56N and a VL comprising the amino acid sequence of the VL of P1-068761_E56N;
(jj) a VH comprising the amino acid sequence of the VH of P1-068761_E55A E56N and a VL comprising the amino acid sequence of the VL of P1-068761_E55A_E56N;
(kk) a VH comprising the amino acid sequence of the VH of P1-068761_E30D and a VL comprising the amino acid sequence of the VL of P1-068761_E30D;
(ll) a VH comprising the amino acid sequence of the VH of P1-068761_E30D E55A and a VL comprising the amino acid sequence of the VL of P1-068761_E30D_E55A;
(mm) a VH comprising the amino acid sequence of the VH of P1-068761_E56N_H100G and a VL comprising the amino acid sequence of the VL of P1-068761_E56N_H100G;
(nn) a VH comprising the amino acid sequence of the VH of P1-068761_E30D_H100G and a VL comprising the amino acid sequence of the VL of P1-068761_E30D_H100G;

(oo) a VH comprising the amino acid sequence of the VH of P1-068761_E30D_E56N and a VL comprising the amino acid sequence of the VL of P1-068761_E30D_E56N;
(pp) a VH comprising the amino acid sequence of the VH of P1-068761_E100fF and a VL comprising the amino acid sequence of the VL of P1-068761_E100fF;
(qq) a VH comprising the amino acid sequence of the VH of P1-068761_E55A_E100fF and a VL comprising the amino acid sequence of the VL of P1-068761_E55A_E100fF;
(rr) a VH comprising the amino acid sequence of the VH of P1-068761_H100G_E100fF and a VL comprising the amino acid sequence of the VL of P1-068761_H100G_E100fF;
(ss) a VH comprising the amino acid sequence of the VH of P1-068761_E30D_E100fF and a VL comprising the amino acid sequence of the VL of P1-068761_E30D_E100fF;
(tt) a VH comprising the amino acid sequence of the VH of P1-068761_E56N_E100fF and a VL comprising the amino acid sequence of the VL of P1-068761_E56N_E100fF;
(uu) a VH comprising the amino acid sequence of the VH of P1-068761_E32Y and a VL comprising the amino acid sequence of the VL of P1-068761_E32Y;
(vv) a VH comprising the amino acid sequence of the VH of P1-068761_E32Y_E55A and a VL comprising the amino acid sequence of the VL of P1-068761_E32Y_E55A;
(ww) a VH comprising the amino acid sequence of the VH of P1-068761_E32Y_E56N and a VL comprising the amino acid sequence of the VL of P1-068761_E32Y_E56N;
(xx) a VH comprising the amino acid sequence of the VH of P1-068761_E30D_E32Y and a VL comprising the amino acid sequence of the VL of P1-068761_E30D_E32Y;
(yy) a VH comprising the amino acid sequence of the VH of P1-068761_E32Y_H100G and a VL comprising the amino acid sequence of the VL of P1-068761-E32Y_H100G;
(zz) a VH comprising the amino acid sequence of the VH of P1-068761_E32Y_E100fF and a VL comprising the amino acid sequence of the VL of P1-068761_E32Y_E100fF;
(aaa) a VH comprising the amino acid sequence of the VH of P1-068767_D52N_D102V and a VL comprising the amino acid sequence of the VL of P1-068767_D52N_D102V;
(bbb) a VH comprising the amino acid sequence of the VH of P1-068767_D52N and a VL comprising the amino acid sequence of the VL of P1-068767_D52N;
(ccc) a VH comprising the amino acid sequence of the VH of P1-068767_D52N_E55A and a VL comprising the amino acid sequence of the VL of P1-068767_D52N_E55A;
(ddd) a VH comprising the amino acid sequence of the VH of P1-068767_E55A_D102V and a VL comprising the amino acid sequence of the VL of P1-068767_E55A_D102V;
(eee) a VH comprising the amino acid sequence of the VH of P1-068767_D102V and a VL comprising the amino acid sequence of the VL of P1-068767_D102V;
(fff) a VH comprising the amino acid sequence of the VH of P1-068767_E55A and a VL comprising the amino acid sequence of the VL of P1-068767_E55A;

(ggg) a VH comprising the amino acid sequence of the VH of P1-068767_E30D_D52N and a VL comprising the amino acid sequence of the VL of P1-068767_E30D_D52N;
(hhh) a VH comprising the amino acid sequence of the VH of P1-068767_E30D_D102V and a VL comprising the amino acid sequence of the VL of P1-068767_E30D_D102V;
(iii) a VH comprising the amino acid sequence of the VH of P1-068767_E30D and a VL comprising the amino acid sequence of the VL of P1-068767_E30D;
(jjj) a VH comprising the amino acid sequence of the VH of P1-068767_E30D_E55A and a VL comprising the amino acid sequence of the VL of P1-068767_E30D_E55A;
(kkk) a VH comprising the amino acid sequence of the VH of P1-068767_E100fF_D102V and a VL comprising the amino acid sequence of the VL of P1-068767_E100fF_D102V;
(lll) a VH comprising the amino acid sequence of the VH of P1-068767_E55A_E100fF and a VL comprising the amino acid sequence of the VL of P1-068767_E55A_E100fF;
(mmm) a VH comprising the amino acid sequence of the VH of P1-068767_D52N_E100fF and a VL comprising the amino acid sequence of the VL of P1-068767 D52N_E100fF;
(nnn) a VH comprising the amino acid sequence of the VH of P1-068767_E100fF and a VL comprising the amino acid sequence of the VL of P1-068767_E100fF;
(ooo) a VH comprising the amino acid sequence of the VH of P1-068767_E30D_E100fF and a VL comprising the amino acid sequence of the VL of P1-068767_E30D_E100fF;
(ppp) a VH comprising the amino acid sequence of the VH of P1-061029_F100fE_V102D and a VL comprising the amino acid sequence of the VL of P1-061029_F100fE_V102D;
(qqq) a VH comprising the amino acid sequence of the VH of P1-061029° F.100fE and a VL comprising the amino acid sequence of the VL of P1-061029_F100fE;
(rrr) a VH comprising the amino acid sequence of the VH of P1-061029_V102D and a VL comprising the amino acid sequence of the VL of P1-061029_V102D;
(sss) a VH comprising the amino acid sequence of the VH of P1-061029_Y32E and a VL comprising the amino acid sequence of the VL of P1-061029_Y32E; or
(ttt) a VH comprising the amino acid sequence of the VH of P1-061029_Y32E_F100fE and a VL comprising the amino acid sequence of the VL of P1-061029_Y32E_F100fE.

An anti-hVISTA Ab may comprise:
(a) a VH comprising the amino acid sequence of the VH of P1-061029 modified by K16R and/or T84A substitutions, and a VL comprising the amino acid sequence of the VL of P1-061029;
(b) a VH comprising the amino acid sequence of the VH of P1-068757 modified by K16R and/or T84A substitutions, and a VL comprising the amino acid sequence of the VL of P1-068757;
(c) a VH comprising the amino acid sequence of the VH of P1-068759 modified by K16R and/or T84A substitutions, and a VL comprising the amino acid sequence of the VL of P1-068759;
(d) a VH comprising the amino acid sequence of the VH of P1-068761 modified by K16R and/or T84A substitutions, and a VL comprising the amino acid sequence of the VL of P1-068761;
(e) a VH comprising the amino acid sequence of the VH of P1-068763 modified by K16R and/or T84A substitutions, and a VL comprising the amino acid sequence of the VL of P1-068763;
(f) a VH comprising the amino acid sequence of the VH of P1-068765 modified by K16R and/or T84A substitutions, and a VL comprising the amino acid sequence of the VL of P1-068765;
(g) a VH comprising the amino acid sequence of the VH of P1-068767 modified by K16R and/or T84A substitutions, and a VL comprising the amino acid sequence of the VL of P1-068767;
(h) a VH comprising the amino acid sequence of the VH of P1-068769 modified by K16R and/or T84A substitutions, and a VL comprising the amino acid sequence of the VL of P1-068769;
(i) a VH comprising the amino acid sequence of the VH of P1-068771 modified by K16R and/or T84A substitutions, and a VL comprising the amino acid sequence of the VL of P1-068771;
(j) a VH comprising the amino acid sequence of the VH of P1-068773 modified by K16R and/or T84A substitutions, and a VL comprising the amino acid sequence of the VL of -068773;
(k) a VH comprising the amino acid sequence of the VH of P1-068775 modified by K16R and/or T84A substitutions, and a VL comprising the amino acid sequence of the VL of P1-068775;
(l) a VH comprising the amino acid sequence of the VH of P1-069059 modified by K16R and/or T84A substitutions, and a VL comprising the amino acid sequence of the VL of P1-069059;
(m) a VH comprising the amino acid sequence of the VH of P1-069061 modified by K16R and/or T84A substitutions, and a VL comprising the amino acid sequence of the VL of P1-069061;
(n) a VH comprising the amino acid sequence of the VH of P1-069063 modified by K16R and/or T84A substitutions, and a VL comprising the amino acid sequence of the VL of P1-069063;
(o) a VH comprising the amino acid sequence of the VH of P1-069065 modified by K16R and/or T84A substitutions, and a VL comprising the amino acid sequence of the VL of P1-069065;
(p) a VH comprising the amino acid sequence of the VH of P1-069067 modified by K16R and/or T84A substitutions, and a VL comprising the amino acid sequence of the VL of P1-069067;
(q) a VH comprising the amino acid sequence of the VH of P1-069069 modified by K16R and/or T84A substitutions, and a VL comprising the amino acid sequence of the VL of P1-069069;
(r) a VH comprising the amino acid sequence of the VH of P1-069071 modified by K16R and/or T84A substitutions, and a VL comprising the amino acid sequence of the VL of P1-069071;
(s) a VH comprising the amino acid sequence of the VH of P1-069073 modified by K16R and/or T84A substitutions, a VL comprising the amino acid sequence of the VL of P1-069073;

(t) a VH comprising the amino acid sequence of the VH of P1-069075 modified by K16R and/or T84A substitutions, and a VL comprising the amino acid sequence of the VL of P1-069075;
(u) a VH comprising the amino acid sequence of the VH of P1-069077 modified by K16R and/or T84A substitutions, and a VL comprising the amino acid sequence of the VL of P1-069077;
(v) a VH comprising the amino acid sequence of the VH of P1-068761_E55A modified by K16R and/or T84A substitutions, and a VL comprising the amino acid sequence of the VL of P1-068761_E55A;
(w) a VH comprising the amino acid sequence of the VH of P1-068761_H100G modified by K16R and/or T84A substitutions, and a VL comprising the amino acid sequence of the VL of P1-068761_H100G;
(x) a VH comprising the amino acid sequence of the VH of P1-068761_E56N modified by K16R and/or T84A substitutions, and a VL comprising the amino acid sequence of the VL of P1-068761_E56N;
(y) a VH comprising the amino acid sequence of the VH of P1-068761_E55A_E56N modified by K16R and/or T84A substitutions, and a VL comprising the amino acid sequence of the VL of P1-068761_E55A_E56N;
(z) a VH comprising the amino acid sequence of the VH of P1-068761_E30D modified by K16R and/or T84A substitutions, and a VL comprising the amino acid sequence of the VL of P1-068761_E30D;
(aa) a VH comprising the amino acid sequence of the VH of P1-068761_E30D_E55A modified by K16R and/or T84A substitutions, and a VL comprising the amino acid sequence of the VL of P1-068761_E30D_E55A;
(bb) a VH comprising the amino acid sequence of the VH of P1-068761_E56N_H100G modified by K16R and/or T84A substitutions, and a VL comprising the amino acid sequence of the VL of P1-068761_E56N_H100G;
(cc) a VH comprising the amino acid sequence of the VH of P1-068761_E30D_H100G modified by K16R and/or T84A substitutions, and a VL comprising the amino acid sequence of the VL of P1-068761_E30D_H100G;
(dd) a VH comprising the amino acid sequence of the VH of P1-068761_E30D_E56N modified by K16R and/or T84A substitutions, and a VL comprising the amino acid sequence of the VL of P1-068761_E30D_E56N;
(ee) a VH comprising the amino acid sequence of the VH of P1-068761_E100fF modified by K16R and/or T84A substitutions, and a VL comprising the amino acid sequence of the VL of P1-068761_E100fF;
(ff) a VH comprising the amino acid sequence of the VH of P1-068761_E55A_E100fF modified by K16R and/or T84A substitutions, and a VL comprising the amino acid sequence of the VL of P1-068761_E55A_E100fF;
(gg) a VH comprising the amino acid sequence of the VH of P1-068761_H100G_E100fF modified by K16R and/or T84A substitutions, and a VL comprising the amino acid sequence of the VL of P1-068761_H100G_E100fF;
(hh) a VH comprising the amino acid sequence of the VH of P1-068761_E30D_E100fF modified by K16R and/or T84A substitutions, and a VL comprising the amino acid sequence of the VL of P1-068761_E30D_E100fF;
(ii) a VH comprising the amino acid sequence of the VH of P1-068761_E56N_E100fF modified by K16R and/or T84A substitutions, and a VL comprising the amino acid sequence of the VL of P1-068761_E56N_E100fF;
(jj) a VH comprising the amino acid sequence of the VH of P1-068761_E32Y modified by K16R and/or T84A substitutions, and a VL comprising the amino acid sequence of the VL of P1-068761_E32Y;
(kk) a VH comprising the amino acid sequence of the VH of P1-068761_E32Y_E55A modified by K16R and/or T84A substitutions, and a VL comprising the amino acid sequence of the VL of P1-068761_E32Y_E55A;
(ll) a VH comprising the amino acid sequence of the VH of P1-068761_E32Y_E56N modified by K16R and/or T84A substitutions, and a VL comprising the amino acid sequence of the VL of P1-068761_E32Y_E56N;
(mm) a VH comprising the amino acid sequence of the VH of P1-068761_E30D_E32Y modified by K16R and/or T84A substitutions, and a VL comprising the amino acid sequence of the VL of P1-068761_E30D_E32Y;
(nn) a VH comprising the amino acid sequence of the VH of P1-068761_E32Y_H100G modified by K16R and/or T84A substitutions, and a VL comprising the amino acid sequence of the VL of P1-068761_E32Y_H100G;
(oo) a VH comprising the amino acid sequence of the VH of P1-068761_E32Y_E100fF modified by K16R and/or T84A substitutions, and a VL comprising the amino acid sequence of the VL of P1-068761_E32Y_E100fF;
(pp) a VH comprising the amino acid sequence of the VH of P1-068767_D52N_D102V modified by K16R and/or T84A substitutions, and a VL comprising the amino acid sequence of the VL of P1-068767_D52N_D102V;
(qq) a VH comprising the amino acid sequence of the VH of P1-068767_D52N modified by K16R and/or T84A substitutions, and a VL comprising the amino acid sequence of the VL of P1-068767_D52N;
(rr) a VH comprising the amino acid sequence of the VH of P1-068767_D52N_E55A modified by K16R and/or T84A substitutions, and a VL comprising the amino acid sequence of the VL of P1-068767_D52N_E55A;
(ss) a VH comprising the amino acid sequence of the VH of P1-068767_E55A_D102V modified by K16R and/or T84A substitutions, and a VL comprising the amino acid sequence of the VL of P1-068767_E55A_D102V;
(tt) a VH comprising the amino acid sequence of the VH of P1-068767_D102V modified by K16R and/or T84A substitutions, a VL comprising the amino acid sequence of the VL of P1-068767_D102V;
(uu) a VH comprising the amino acid sequence of the VH of P1-068767_E55A modified by K16R and/or T84A substitutions, and a VL comprising the amino acid sequence of the VL of P1-068767_E55A;
(vv) a VH comprising the amino acid sequence of the VH of P1-068767_E30D_D52N modified by K16R and/or T84A substitutions, and a VL comprising the amino acid sequence of the VL of P1-068767_E30D_D52N;
(ww) a VH comprising the amino acid sequence of the VH of P1-068767_E30D_D102V modified by K16R and/or T84A substitutions, and a VL comprising the amino acid sequence of the VL of P1-068767_E30D_D102V;
(xx) a VH comprising the amino acid sequence of the VH of P1-068767_E30D modified by K16R and/or T84A substitutions, and a VL comprising the amino acid sequence of the VL of P1-068767_E30D;
(yy) a VH comprising the amino acid sequence of the VH of P1-068767_E30D_E55A modified by K16R and/or T84A substitutions, and a VL comprising the amino acid sequence of the VL of P1-068767_E30D_E55A;
(zz) a VH comprising the amino acid sequence of the VH of P1-068767_E100fF_D102V modified by K16R and/or T84A substitutions, and a VL comprising the amino acid sequence of the VL of P1-068767_E100fF_D102V;

(aaa) a VH comprising the amino acid sequence of the VH of P1-068767_E55A_E100fF modified by K16R and/or T84A substitutions, and a VL comprising the amino acid sequence of the VL of P1-068767_E55A_E100fF;

(bbb) a VH comprising the amino acid sequence of the VH of P1-068767_D52N_E100fF modified by K16R and/or T84A substitutions, and a VL comprising the amino acid sequence of the VL of P1-068767_D52N_E100fF;

(ccc) a VH comprising the amino acid sequence of the VH of P1-068767_E100fF modified by K16R and/or T84A substitutions and a VL comprising the amino acid sequence of the VL of P1-068767_E100fF;

(ddd) a VH comprising the amino acid sequence of the VH of P1-068767_E30D_E100fF modified by K16R and/or T84A substitutions and a VL comprising the amino acid sequence of the VL of P1-068767_E30D_E100fF;

(eee) a VH comprising the amino acid sequence of the VH of P1-061029_F100fE_V102D modified by K16R and/or T84A substitutions and a VL comprising the amino acid sequence of the VL of P1-061029_F100fE_V102D;

(fff) a VH comprising the amino acid sequence of the VH of P1-061029_F100fE modified by K16R and/or T84A substitutions and a VL comprising the amino acid sequence of the VL of P1-061029_F100fE;

(ggg) a VH comprising the amino acid sequence of the VH of P1-061029_V102D modified by K16R and/or T84A substitutions and a VL comprising the amino acid sequence of the VL of P1-061029_V102D;

(hhh) a VH comprising the amino acid sequence of the VH of P1-061029_Y32E modified by K16R and/or T84A substitutions and a VL comprising the amino acid sequence of the VL of P1-061029_Y32E; or (iii) a VH comprising the amino acid sequence of the VH of P1-061029_Y32E_F100fE modified by K16R and/or T84A substitutions and a VL comprising the amino acid sequence of the VL of P1-061029_Y32E_F100fE.

An anti-hVISTA Ab may comprise:

(a) a VH comprising the VH CDRs of the VH of P1-061029 and a VL comprising the VL CDRs of P1-061029 and VH and VL amino acid sequences that are at least 90%, at least 91%, at least 92%, at least 93%, at least 94%, at least 95%, at least 96%, at least 97%, at least 98%, or at least 99% identical to the VH and VL of P1-061029;

(b) a VH comprising the VH CDRs of the VH of P1-061015 and a VL comprising the VL CDRs of P1-061015 and VH and VL amino acid sequences that are at least 90%, at least 91%, at least 92%, at least 93%, at least 94%, at least 95%, at least 96%, at least 97%, at least 98%, or at least 99% identical to the VH and VL of P1-061015;

(c) a VH comprising the VH CDRs of the VH of P1-068757 and a VL comprising the VL CDRs of P1-068757 and VH and VL amino acid sequences that are at least 90%, at least 91%, at least 92%, at least 93%, at least 94%, at least 95%, at least 96%, at least 97%, at least 98%, or at least 99% identical to the VH and VL of P1-068757;

(d) a VII comprising the VH CDRs of the VH of P1-068759 and a VL comprising the VL CDRs of P1-068759 and VH and VL amino acid sequences that are at least 90%, at least 91%, at least 92%, at least 93%, at least 94%, at least 95%, at least 96%, at least 97%, at least 98%, or at least 99% identical to the VH and VL of P1-068759;

(e) a VH comprising the VH CDRs of the VH of P1-068761 and a VL comprising the VL CDRs of P1-068761 and VH and VL amino acid sequences that are at least 90%, at least 91%, at least 92%, at least 93%, at least 94%, at least 95%, at least 96%, at least 97%, at least 98%, or at least 99% identical to the VH and VL of P1-068761;

(f) a VH comprising the VH CDRs of the VH of P1-068763 and a VL comprising the VL CDRs of P1-068763 and VH and VL amino acid sequences that are at least 90%, at least 91%, at least 92%, at least 93%, at least 94%, at least 95%, at least 96%, at least 97%, at least 98%, or at least 99% identical to the VH and VL of P1-068763;

(g) a VH comprising the VH CDRs of the VH of P1-068765 and a VL comprising the VL CDRs of P1-068765 and VH and VL amino acid sequences that are at least 90%, at least 91%, at least 92%, at least 93%, at least 94%, at least 95%, at least 96%, at least 97%, at least 98%, or at least 99% identical to the VH and VL of P1-068765;

(h) a VH comprising the VH CDRs of the VH of P1-068767 and a VL comprising the VL CDRs of P1-068767 and VH and VL amino acid sequences that are at least 90%, at least 91%, at least 92%, at least 93%, at least 94%, at least 95%, at least 96%, at least 97%, at least 98%, or at least 99% identical to the VH and VL of P1-068767;

(i) a VH comprising the VH CDRs of the VH of P1-068769 and a VL comprising the VL CDRs of P1-068769 and VH and VL amino acid sequences that are at least 90%, at least 91%, at least 92%, at least 93%, at least 94%, at least 95%, at least 96%, at least 97%, at least 98%, or at least 99% identical to the VH and VL of P1-068769;

(j) a VH comprising the VH CDRs of the VH of P1-068771 and a VL comprising the VL CDRs of P1-068771 and VH and VL amino acid sequences that are at least 90%, at least 91%, at least 92%, at least 93%, at least 94%, at least 95%, at least 96%, at least 97%, at least 98%, or at least 99% identical to the VH and VL of P1-068771;

(k) a VH comprising the VH CDRs of the VH of P1-068773 and a VL comprising the VL CDRs of P1-068773 and VH and VL amino acid sequences that are at least 90%, at least 91%, at least 92%, at least 93%, at least 94%, at least 95%, at least 96%, at least 97%, at least 98%, or at least 99% identical to the VH and VL of P1-068773;

(l) a VH comprising the VH CDRs of the VH of P1-068775 and a VL comprising the VL CDRs of P1-068775 and VH and VL amino acid sequences that are at least 90%, at least 91%, at least 92%, at least 93%, at least 94%, at least 95%, at least 96%, at least 97%, at least 98%, or at least 99% identical to the VH and VL of P1-068775;

(m) a VH comprising the VH CDRs of the VH of P1-069059 and a VL comprising the VL CDRs of P1-069059 and VH and VL amino acid sequences that are at least 90%, at least 91%, at least 92%, at least 93%, at least 94%, at least 95%, at least 96%, at least 97%, at least 98%, or at least 99% identical to the VH and VL of P1-069059;

(n) a VH comprising the VH CDRs of the VH of P1-069061 and a VL comprising the VL CDRs of P1-069061 and VH and VL amino acid sequences that are at least 90%, at least 91%, at least 92%, at least 93%, at least 94%, at least 95%, at least 96%, at least 97%, at least 98%, or at least 99% identical to the VH and VL of P1-069061;

(o) a VH comprising the VH CDRs of the VH of P1-069063 and a VL comprising the VL CDRs of P1-069063 and VH and VL amino acid sequences that are at least 90%, at least 91%, at least 92%, at least 93%, at least 94%, at least 95%, at least 96%, at least 97%, at least 98%, or at least 99% identical to the VH and VL of P1-069063;

(p) a VH comprising the VH CDRs of the VH of P1-069065 and a VL comprising the VL CDRs of P1-069065 and VH and VL amino acid sequences that are at least 90%, at least 91%, at least 92%, at least 93%, at least 94%, at least 95%, at least 96%, at least 97%, at least 98%, or at least 99% identical to the VH and VL of P1-069065;

(q) a VH comprising the VH CDRs of the VH of P1-069067 and a VL comprising the VL CDRs of P1-069067 and VH and VL amino acid sequences that are at least 90%, at least 91%, at least 92%, at least 93%, at least 94%, at least 95%, at least 96%, at least 97%, at least 98%, or at least 99% identical to the VH and VL of P1-069067;

(r) a VH comprising the VH CDRs of the VH of P1-069069 and a VL comprising the VL CDRs of P1-069069 and VH and VL amino acid sequences that are at least 90%, at least 91%, at least 92%, at least 93%, at least 94%, at least 95%, at least 96%, at least 97%, at least 98%, or at least 99% identical to the VH and VL of P1-069069;

(s) a VH comprising the VH CDRs of the VH of P1-069071 and a VL comprising the VL CDRs of P1-069071 and VH and VL amino acid sequences that are at least 90%, at least 91%, at least 92%, at least 93%, at least 94%, at least 95%, at least 96%, at least 97%, at least 98%, or at least 99% identical to the VH and VL of P1-069071;

(t) a VH comprising the VH CDRs of the VH of P1-069073 and a VL comprising the VL CDRs of P1-069073 and VH and VL amino acid sequences that are at least 90%, at least 91%, at least 92%, at least 93%, at least 94%, at least 95%, at least 96%, at least 97%, at least 98%, or at least 99% identical to the VH and VL of P1-069073;

(u) a VH comprising the VH CDRs of the VH of P1-069075 and a VL comprising the VL CDRs of P1-069075 and VH and VL amino acid sequences that are at least 90%, at least 91%, at least 92%, at least 93%, at least 94%, at least 95%, at least 96%, at least 97%, at least 98%, or at least 99% identical to the VH and VL of P1-069075;

(v) a VH comprising the VH CDRs of the VH of P1-069077 and a VL comprising the VL CDRs of P1-069077 and VH and VL amino acid sequences that are at least 90%, at least 91%, at least 92%, at least 93%, at least 94%, at least 95%, at least 96%, at least 97%, at least 98%, or at least 99% identical to the VH and VL of P1-069077;

(w) a VH comprising the VH CDRs of the VH of P1-068736 and a VL comprising the VL CDRs of P1-068736 and VH and VL amino acid sequences that are at least 90%, at least 91%, at least 92%, at least 93%, at least 94%, at least 95%, at least 96%, at least 97%, at least 98%, or at least 99% identical to the VH and VL of P1-068736;

(x) a VH comprising the VH CDRs of the VH of P1-068738 and a VL comprising the VL CDRs of P1-068738 and VH and VL amino acid sequences that are at least 90%, at least 91%, at least 92%, at least 93%, at least 94%, at least 95%, at least 96%, at least 97%, at least 98%, or at least 99% identical to the VH and VL of P1-068738;

(y) a VH comprising the VH CDRs of the VH of P1-068740 and a VL comprising the VL CDRs of P1-068740 and VH and VL amino acid sequences that are at least 90%, at least 91%, at least 92%, at least 93%, at least 94%, at least 95%, at least 96%, at least 97%, at least 98%, or at least 99% identical to the VH and VL of P1-068740;

(z) a VH comprising the VH CDRs of the VH of P1-068742 and a VL comprising the VL CDRs of P1-068742 and VH and VL amino acid sequences that are at least 90%, at least 91%, at least 92%, at least 93%, at least 94%, at least 95%, at least 96%, at least 97%, at least 98%, or at least 99% identical to the VH and VL of P1-068742;

(aa) a VH comprising the VH CDRs of the VH of P1-068744 and a VL comprising the VL CDRs of P1-068744 and VH and VL amino acid sequences that are at least 90%, at least 91%, at least 92%, at least 93%, at least 94%, at least 95%, at least 96%, at least 97%, at least 98%, or at least 99% identical to the VH and VL of P1-068744;

(bb) a VH comprising the VH CDRs of the VH of P1-068746 and a VL comprising the VL CDRs of P1-068746 and VH and VL amino acid sequences that are at least 90%, at least 91%, at least 92%, at least 93%, at least 94%, at least 95%, at least 96%, at least 97%, at least 98%, or at least 99% identical to the VH and VL of P1-068746;

(cc) a VH comprising the VH CDRs of the VH of P1-068748 and a VL comprising the VL CDRs of P1-068748 and VH and VL amino acid sequences that are at least 90%, at least 91%, at least 92%, at least 93%, at least 94%, at least 95%, at least 96%, at least 97%, at least 98%, or at least 99% identical to the VH and VL of P1-068748;

(dd) a VH comprising the VH CDRs of the VH of P1-068750 and a VL comprising the VL CDRs of P1-068750 and VH and VL amino acid sequences that are at least 90%, at least 91%, at least 92%, at least 93%, at least 94%, at least 95%, at least 96%, at least 97%, at least 98%, or at least 99% identical to the VH and VL of P1-068750;

(ee) a VH comprising the VH CDRs of the VH of P1-068752 and a VL comprising the VL CDRs of P1-068752 and VH and VL amino acid sequences that are at least 90%, at least 91%, at least 92%, at least 93%, at least 94%, at least 95%, at least 96%, at least 97%, at least 98%, or at least 99% identical to the VH and VL of P1-068752;

(ff) a VH comprising the VH CDRs of the VH of P1-068754 and a VL comprising the VL CDRs of P1-068754 and VH and VL amino acid sequences that are at least 90%, at least 91%, at least 92%, at least 93%, at least 94%, at least 95%, at least 96%, at least 97%, at least 98%, or at least 99% identical to the VH and VL of P1-068754;

(gg) a VH comprising the VH CDRs of the VH of P1-068761_E55A and a VL comprising the VL CDRs of P1-068761_E55A and VH and VL amino acid sequences that are at least 90%, at least 91%, at least 92%, at least 93%, at least 94%, at least 95%, at least 96%, at least 97%, at least 98%, or at least 99% identical to the VH and VL of P1-068761_E55A;

(hh) a VH comprising the VH CDRs of the VH of P1-068761_H100G and a VL comprising the VL CDRs of P1-068761_H100G and VH and VL amino acid sequences that are at least 90%, at least 91%, at least 92%, at least 93%, at least 94%, at least 95%, at least 96%, at least 97%, at least 98%, or at least 99% identical to the VH and VL of P1-068761_H100G;

(ii) a VH comprising the VH CDRs of the VH of P1-068761_E56N and a VL comprising the VL CDRs of P1-068761_E56N and VH and VL amino acid sequences that are at least 90%, at least 91%, at least 92%, at least 93%, at least 94%, at least 95%, at least 96%, at least 97%, at least 98%, or at least 99% identical to the VH and VL of P1-068761_E56N;

(jj) a VH comprising the VH CDRs of the VH of P1-068761_E55A_E56N and a VL comprising the VL CDRs of P1-068761_E55A_E56N and VH and VL amino acid sequences that are at least 90%, at least 91%, at least 92%, at least 93%, at least 94%, at least 95%, at least 96%, at least 97%, at least 98%, or at least 99% identical to the VH and VL of P1-068761_E55A_E56N;

(kk) a VH comprising the VH CDRs of the VH of P1-068761_E30D and a VL comprising the VL CDRs of P1-068761_E30D and VH and VL amino acid sequences that are at least 90%, at least 91%, at least 92%, at least 93%, at least 94%, at least 95%, at least 96%, at least 97%, at least 98%, or at least 99% identical to the VH and VL of P1-068761_E30D;

(ll) a VH comprising the VH CDRs of the VH of P1-068761_E30D E55A and a VL comprising the VL CDRs of P1-068761_E30D E55A and VH and VL amino acid sequences that are at least 90%, at least 91%, at least 92%, at least 93%, at least 94%, at least 95%, at least 96%, at least 97%, at least 98%, or at least 99% identical to the VH and VL of P1-068761_E30D_E55A;

(mm) a VH comprising the VH CDRs of the VH of P1-068761_E56N_H100G and a VL comprising the VL CDRs of P1-068761_E56N_H100G and VH and VL amino acid sequences that are at least 90%, at least 91%, at least 92%, at least 93%, at least 94%, at least 95%, at least 96%, at least 97%, at least 98%, or at least 99% identical to the VH and VL of P1-068761-E56N_H100G;

(nn) a VH comprising the VH CDRs of the VH of P1-068761_E30D_H100G and a VL comprising the VL CDRs of P1-068761_E30D_H100G and VH and VL amino acid sequences that are at least 90%, at least 91%, at least 92%, at least 93%, at least 94%, at least 95%, at least 96%, at least 97%, at least 98%, or at least 99% identical to the VH and VL of P1-068761_E30D_H100G;

(oo) a VH comprising the VH CDRs of the VH of P1-068761_E30D E56N and a VL comprising the VL CDRs of P1-068761_E30D E56N and VH and VL amino acid sequences that are at least 90%, at least 91%, at least 92%, at least 93%, at least 94%, at least 95%, at least 96%, at least 97%, at least 98%, or at least 99% identical to the VH and VL of P1-068761_E30D_E56N;

(pp) a VH comprising the VH CDRs of the VH of P1-068761_E100fF and a VL comprising the VL CDRs of P1-068761_E100fF and VH and VL amino acid sequences that are at least 90%, at least 91%, at least 92%, at least 93%, at least 94%, at least 95%, at least 96%, at least 97%, at least 98%, or at least 99% identical to the VH and VL of P1-068761_E100fF;

(qq) a VH comprising the VH CDRs of the VH of P1-068761_E55A_E100fF and a VL comprising the VL CDRs of P1-068761_E55A-E100fF and VH and VL amino acid sequences that are at least 90%, at least 91%, at least 92%, at least 93%, at least 94%, at least 95%, at least 96%, at least 97%, at least 98%, or at least 99% identical to the VH and VL of P1-068761_E55A_E100fF;

(rr) a VH comprising the VH CDRs of the VH of P1-068761_H100G_E100fF and a VL comprising the VL CDRs of P1-068761_H100G_E100fF and VH and VL amino acid sequences that are at least 90%, at least 91%, at least 92%, at least 93%, at least 94%, at least 95%, at least 96%, at least 97%, at least 98%, or at least 99% identical to the VH and VL of P1-068761-H100G_E100fF;

(ss) a VH comprising the VH CDRs of the VH of P1-068761_E30D_E100fF and a VL comprising the VL CDRs of P1-068761_E30D_E100fF and VH and VL amino acid sequences that are at least 90%, at least 91%, at least 92%, at least 93%, at least 94%, at least 95%, at least 96%, at least 97%, at least 98%, or at least 99% identical to the VH and VL of P1-068761_E30D_E100fF;

(tt) a VH comprising the VH CDRs of the VH of P1-068761_E56N_E100fF and a VL comprising the VL CDRs of P1-068761_E56N_E100fF and VH and VL amino acid sequences that are at least 90%, at least 91%, at least 92%, at least 93%, at least 94%, at least 95%, at least 96%, at least 97%, at least 98%, or at least 99% identical to the VH and VL of P1-068761_E56N_E100fF;

(uu) a VH comprising the VH CDRs of the VH of P1-068761_E32Y and a VL comprising the VL CDRs of P1-068761_E32Y and VH and VL amino acid sequences that are at least 90%, at least 91%, at least 92%, at least 93%, at least 94%, at least 95%, at least 96%, at least 97%, at least 98%, or at least 99% identical to the VH and VL of P1-068761_E32Y;

(vv) a VH comprising the VH CDRs of the VH of P1-068761_E32Y_E55A and a VL comprising the VL CDRs of P1-068761_E32Y_E55A and VH and VL amino acid sequences that are at least 90%, at least 91%, at least 92%, at least 93%, at least 94%, at least 95%, at least 96%, at least 97%, at least 98%, or at least 99% identical to the VH and VL of P1-068761_E32Y_E55A;

(ww) a VH comprising the VH CDRs of the VH of P1-068761_E32Y_E56N and a VL comprising the VL CDRs of P1-068761_E32Y_E56N and VH and VL amino acid sequences that are at least 90%, at least 91%, at least 92%, at least 93%, at least 94%, at least 95%, at least 96%, at least 97%, at least 98%, or at least 99% identical to the VH and VL of P1-068761_E32Y_E56N;

(xx) a VH comprising the VH CDRs of the VH of P1-068761_E30D E32Y and a VL comprising the VL CDRs of P1-068761_E30D_E32Y and VH and VL amino acid sequences that are at least 90%, at least 91%, at least 92%, at least 93%, at least 94%, at least 95%, at least 96%, at least 97%, at least 98%, or at least 99% identical to the VH and VL of P1-068761_E30D_E32Y;
(yy) a VH comprising the VH CDRs of the VH of P1-068761_E32Y__H100G and a VL comprising the VL CDRs of P1-068761_E32Y_H100G and VH and VL amino acid sequences that are at least 90%, at least 91%, at least 92%, at least 93%, at least 94%, at least 95%, at least 96%, at least 97%, at least 98%, or at least 99% identical to the VH and VL of P1-068761_E32Y_H100G;
(zz) a VH comprising the VH CDRs of the VH of P1-068761_E32Y_E100fF and a VL comprising the VL CDRs of P1-068761_E32Y_E100fF and VH and VL amino acid sequences that are at least 90%, at least 91%, at least 92%, at least 93%, at least 94%, at least 95%, at least 96%, at least 97%, at least 98%, or at least 99% identical to the VH and VL of P1-068761_E32Y_E100fF;
(aaa) a VH comprising the VH CDRs of the VH of P1-068767_D52N_D102V and a VL comprising the VL CDRs of P1-068767_D52N_D102V and VH and VL amino acid sequences that are at least 90%, at least 91%, at least 92%, at least 93%, at least 94%, at least 95%, at least 96%, at least 97%, at least 98%, or at least 99% identical to the VH and VL of P1-068767_D52N_D102V;
(bbb) a VH comprising the VH CDRs of the VH of P1-068767_D52N and a VL comprising the VL CDRs of P1-068767_D52N and VH and VL amino acid sequences that are at least 90%, at least 91%, at least 92%, at least 93%, at least 94%, at least 95%, at least 96%, at least 97%, at least 98%, or at least 99% identical to the VH and VL of P1-068767_D52N;
(ccc) a VH comprising the VH CDRs of the VH of P1-068767_D52N_E55A and a VL comprising the VL CDRs of P1-068767 D52N_E55A and VH and VL amino acid sequences that are at least 90%, at least 91%, at least 92%, at least 93%, at least 94%, at least 95%, at least 96%, at least 97%, at least 98%, or at least 99% identical to the VH and VL of P1-068767_D52N_E55A;
(ddd) a VH comprising the VH CDRs of the VH of P1-068767 E55A_D102V and a VL comprising the VL CDRs of P1-068767_E55A_D102V and VH and VL amino acid sequences that are at least 90%, at least 91%, at least 92%, at least 93%, at least 94%, at least 95%, at least 96%, at least 97%, at least 98%, or at least 99% identical to the VH and VL of P1-068767_E55A_D102V;
(eee) a VH comprising the VH CDRs of the VH of P1-068767_D102V and a VL comprising the VL CDRs of P1-068767_D102V and VH and VL amino acid sequences that are at least 90%, at least 91%, at least 92%, at least 93%, at least 94%, at least 95%, at least 96%, at least 97%, at least 98%, or at least 99% identical to the VH and VL of P1-068767_D102V;
(fff) a VH comprising the VH CDRs of the VH of P1-068767_E55A and a VL comprising the VL CDRs of P1-068767_E55A and VH and VL amino acid sequences that are at least 90%, at least 91%, at least 92%, at least 93%, at least 94%, at least 95%, at least 96%, at least 97%, at least 98%, or at least 99% identical to the VH and VL of P1-068767_E55A;
(ggg) a VH comprising the VH CDRs of the VH of P1-068767_E30D_D52N and a VL comprising the VL CDRs of P1-068767 E30D_D52N and VH and VL amino acid sequences that are at least 90%, at least 91%, at least 92%, at least 93%, at least 94%, at least 95%, at least 96%, at least 97%, at least 98%, or at least 99% identical to the VH and VL of P1-068767_E30D_D52N;
(hhh) a VH comprising the VH CDRs of the VH of P1-068767_E30D_D102V and a VL comprising the VL CDRs of P1-068767_E30D_D102V and VH and VL amino acid sequences that are at least 90%, at least 91%, at least 92%, at least 93%, at least 94%, at least 95%, at least 96%, at least 97%, at least 98%, or at least 99% identical to the VH and VL of P1-068767_E30D_D102V;
(iii) a VH comprising the VH CDRs of the VH of P1-068767_E30D and a VL comprising the VL CDRs of P1-068767_E30D and VH and VL amino acid sequences that are at least 90%, at least 91%, at least 92%, at least 93%, at least 94%, at least 95%, at least 96%, at least 97%, at least 98%, or at least 99% identical to the VH and VL of P1-068767_E30D;
(jjj) a VH comprising the VH CDRs of the VH of P1-068767 E30D E55A and a VL comprising the VL CDRs of P1-068767_E30D_E55A and VH and VL amino acid sequences that are at least 90%, at least 91%, at least 92%, at least 93%, at least 94%, at least 95%, at least 96%, at least 97%, at least 98%, or at least 99% identical to the VH and VL of P1-068767_E30D_E55A;
(kkk) a VH comprising the VH CDRs of the VH of P1-068767_E100fF_D102V and a VL comprising the VL CDRs of P1-068767_E100fF_D102V and VH and VL amino acid sequences that are at least 90%, at least 91%, at least 92%, at least 93%, at least 94%, at least 95%, at least 96%, at least 97%, at least 98%, or at least 99% identical to the VH and VL of P1-068767_E100fF_D102V;
(lll) a VH comprising the VH CDRs of the VH of P1-068767_E55A E100fF and a VL comprising the VL CDRs of P1-068767_E55A E100fF and VH and VL amino acid sequences that are at least 90%, at least 91%, at least 92%, at least 93%, at least 94%, at least 95%, at least 96%, at least 97%, at least 98%, or at least 99% identical to the VH and VL of P1-068767_E55A_E100fF;
(mmm) a VH comprising the VH CDRs of the VH of P1-068767 D52N_E100fF and a VL comprising the VL CDRs of P1-068767 D52N_E100fF and VH and VL amino acid sequences that are at least 90%, at least 91%, at least 92%, at least 93%, at least 94%, at least 95%, at least 96%, at least 97%, at least 98%, or at least 99% identical to the VH and VL of P1-068767_D52N_E100fF;
(nnn) a VH comprising the VH CDRs of the VH of P1-068767_E100fF and a VL comprising the VL CDRs of P1-068767_E100fF and VH and VL amino acid sequences that are at least 90%, at least 91%, at least 92%, at least 93%, at least 94%, at least 95%, at least 96%, at least 97%, at least 98%, or at least 99% identical to the VH and VL of P1-068767_E100fF;
(ooo) a VH comprising the VH CDRs of the VH of P1-068767_E30D_E100fF and a VL comprising the VL CDRs of P1-068767_E30D_E100fF and VH and VL amino acid sequences that are at least 90%, at least 91%, at least 92%, at least 93%, at least 94%, at least 95%, at least 96%, at least 97%, at least 98%, or at least 99% identical to the VH and VL of P1-068767_E30D_E100fF;

(ppp) a VH comprising the VH CDRs of the VH of P1-061029_F100fE_V102D and a VL comprising the VL CDRs of P1-061029_F100fE_V102D and VH and VL amino acid sequences that are at least 90%, at least 91%, at least 92%, at least 93%, at least 94%, at least 95%, at least 96%, at least 97%, at least 98%, or at least 99% identical to the VH and VL of P1-061029_F100fE_V102D;

(qqq) a VH comprising the VH CDRs of the VH of P1-061029_F100fE and a VL comprising the VL CDRs of P1-061029_F00fE and VH and VL amino acid sequences that are at least 90%, at least 91%, at least 92%, at least 93%, at least 94%, at least 95%, at least 96%, at least 97%, at least 98%, or at least 99% identical to the VH and VL of P1-061029_F100fE;

(rrr) a VH comprising the VH CDRs of the VH of P1-061029_V102D and a VL comprising the VL CDRs of P1-061029_V102D and VH and VL amino acid sequences that are at least 90%, at least 91%, at least 92%, at least 93%, at least 94%, at least 95%, at least 96%, at least 97%, at least 98%, or at least 99% identical to the VH and VL of P1-061029_V102D;

(sss) a VH comprising the VH CDRs of the VH of P1-061029_Y32E and a VL comprising the VL CDRs of P1-061029_Y32E and VH and VL amino acid sequences that are at least 90%, at least 91%, at least 92%, at least 93%, at least 94%, at least 95%, at least 96%, at least 97%, at least 98%, or at least 99% identical to the VH and VL of P1-061029_Y32E; or (ttt) a VH comprising the VH CDRs of the VH of P1-061029_Y32E_F100fE and a VL comprising the VL CDRs of P1-061029_Y32E_F100fE and VH and VL amino acid sequences that are at least 90%, at least 91%, at least 92%, at least 93%, at least 94%, at least 95%, at least 96%, at least 97%, at least 98%, or at least 99% identical to the VH and VL of P1-061029_Y32E_F100fE;

optionally wherein the VH in any of (a) to (ttt) comprises one or both of the K16R and T84A substitutions.

In some of the above embodiments, the VH and/or VL may differ from the sequence of each of the species (a) to (ttt) by the presence of 1, 2, 3, 4, or 5 amino acid substitutions, such as 1, 2, 3, 4, or 5 conservative substitutions. In some embodiments, the VH may comprise one or both of the K16R and T84A substitutions.

An anti-hVISTA Ab may comprise:

(a) a VH consisting of the amino acid sequence of the VH of P1-061029 and a VL consisting of the VL of P1-061029;

(b) a VH consisting of the amino acid sequence of the VH of P1-061015 and a VL consisting of the VL of P1-061015;

(c) a VH consisting of the amino acid sequence of the VH of P1-068757 and a VL consisting of the VL of P1-068757;

(d) a VH consisting of the amino acid sequence of the VH of P1-068759 and a VL consisting of the VL of P1-068759;

(e) a VH consisting of the amino acid sequence of the VH of P1-068761 and a VL consisting of the VL of P1-068761;

(f) a VH consisting of the amino acid sequence of the VH of P1-068763 and a VL consisting of the VL of P1-068763;

(g) a VH consisting of the amino acid sequence of the VH of P1-068765 and a VL consisting of the VL of P1-068765;

(h) a VH consisting of the amino acid sequence of the VH of P1-068767 and a VL consisting of the VL of P1-068767;

(i) a VH consisting of the amino acid sequence of the VH of P1-068769 and a VL consisting of the VL of P1-068769;

(j) a VH consisting of the amino acid sequence of the VH of P1-068771 and a VL consisting of the VL of P1-068771;

(k) a VH consisting of the amino acid sequence of the VH of P1-068773 and a VL consisting of the VL of P1-068773;

(l) a VH consisting of the amino acid sequence of the VH of P1-068775 and a VL consisting of the VL of P1-068775;

(m) a VH consisting of the amino acid sequence of the VH of P1-069059 and a VL consisting of the VL of P1-069059;

(n) a VH consisting of the amino acid sequence of the VH of P1-069061 and a VL consisting of the VL of P1-069061;

(o) a VH consisting of the amino acid sequence of the VH of P1-069063 and a VL consisting of the VL of P1-069063;

(p) a VH consisting of the amino acid sequence of the VH of P1-069065 and a VL consisting of the VL of P1-069065;

(q) a VH consisting of the amino acid sequence of the VH of P1-069067 and a VL consisting of the VL of P1-069067;

(r) a VH consisting of the amino acid sequence of the VH of P1-069069 and a VL consisting of the VL of P1-069069;

(s) a VH consisting of the amino acid sequence of the VH of P1-069071 and a VL consisting of the VL of P1-069071;

(t) a VH consisting of the amino acid sequence of the VH of P1-069073 and a VL consisting of the VL of P1-069073;

(u) a VH consisting of the amino acid sequence of the VH of P1-069075 and a VL consisting of the VL of P1-069075;

(v) a VH consisting of the amino acid sequence of the VH of P1-069077 and a VL consisting of the VL of P1-069077;

(w) a VH consisting of the amino acid sequence of the VH of P1-068736 and a VL consisting of the VL of P1-068736;

(x) a VH consisting of the amino acid sequence of the VH of P1-068738 and a VL consisting of the VL of P1-068738;

(y) a VH consisting of the amino acid sequence of the VH of P1-068740 and a VL consisting of the VL of P1-068740;

(z) a VH consisting of the amino acid sequence of the VH of P1-068742 and a VL consisting of the VL of P1-068742;

(aa) a VH consisting of the amino acid sequence of the VH of P1-068744 and a VL consisting of the VL of P1-068744;

(bb) a VH consisting of the amino acid sequence of the VH f P1-068746 and a VL consisting of the VL of P1-068746;

(cc) a VH consisting of the amino acid sequence of the VH of P1-068748 and a VL consisting of the VL of P1-068748;
(dd) a VH consisting of the amino acid sequence of the VH of P1-068750 and a VL consisting of the VL of P1-068750;
(ee) a VH consisting of the amino acid sequence of the VH of P1-068752 and a VL consisting of the VL of P1-068752;
(ff) a VH consisting of the amino acid sequence of the VH of P1-068754 and a VL consisting of the VL of P1-068754;
(gg) a VH consisting of the amino acid sequence of the VH of P1-068761_E55A and a VL consisting of the amino acid sequence of the VL of P1-068761_E55A;
(hh) a VH consisting of the amino acid sequence of the VH of P1-068761_H100G and a VL consisting of the amino acid sequence of the VL of P1-068761_H100G;
(ii) a VH consisting of the amino acid sequence of the VH of P1-068761_E56N and a VL consisting of the amino acid sequence of the VL of P1-068761_E56N;
(jj) a VH consisting of the amino acid sequence of the VH of P1-068761_E55A_E56N and a VL consisting of the amino acid sequence of the VL of P1-068761_E55A_E56N;
(kk) a VH consisting of the amino acid sequence of the VH of P1-068761_E30D and a VL consisting of the amino acid sequence of the VL of P1-068761_E30D;
(ll) a VH consisting of the amino acid sequence of the VH of P1-068761_E30D_E55A and a VL consisting of the amino acid sequence of the VL of P1-068761_E30D_E55A;
(mm) a VH consisting of the amino acid sequence of the VH of P1-068761_E56N_H100G and a VL consisting of the amino acid sequence of the VL of P1-068761_E56N_H100G;
(nn) a VH consisting of the amino acid sequence of the VH of P1-068761_E30D_H100G and a VL consisting of the amino acid sequence of the VL of P1-068761_E30D_H100G;
(oo) a VH consisting of the amino acid sequence of the VH of P1-068761_E30D_E56N and a VL consisting of the amino acid sequence of the VL of P1-068761_E30D_E56N;
(pp) a VH consisting of the amino acid sequence of the VH of P1-068761_E100fF and a VL consisting of the amino acid sequence of the VL of P1-068761_E100fF;
(qq) a VH consisting of the amino acid sequence of the VH of P1-068761-E55A_E100fF and a VL consisting of the amino acid sequence of the VL of P1-068761_E55A_E100fF;
(rr) a VH consisting of the amino acid sequence of the VH of P1-068761_H100G_E100fF and a VL consisting of the amino acid sequence of the VL of P1-068761_H100G_E100fF;
(ss) a VH consisting of the amino acid sequence of the VH of P1-068761_E30D_E100fF and a VL consisting of the amino acid sequence of the VL of P1-068761_E30D E100fF;
(tt) a VH consisting of the amino acid sequence of the VH of P1-068761_E56N_E100fF and a VL consisting of the amino acid sequence of the VL of P1-068761_E56N_E100fF;
(uu) a VH consisting of the amino acid sequence of the VH of P1-068761_E32Y and a VL consisting of the amino acid sequence of the VL of P1-068761_E32Y;

(vv) a VH consisting of the amino acid sequence of the VH of P1-068761_E32Y_E55A and a VL consisting of the amino acid sequence of the VL of P1-068761_E32Y_E55A;
(ww) a VH consisting of the amino acid sequence of the VH of P1-068761_E32Y_E56N and a VL consisting of the amino acid sequence of the VL of P1-068761_E32Y_E56N;
(xx) a VH consisting of the amino acid sequence of the VH of P1-068761_E30D_E32Y and a VL consisting of the amino acid sequence of the VL of P1-068761_E30D E32Y;
(yy) a VH consisting of the amino acid sequence of the VH of P1-068761_E32Y__H100G and a VL consisting of the amino acid sequence of the VL of P1-068761_E32Y_H100G;
(zz) a VH consisting of the amino acid sequence of the VH of P1-068761_E32Y_E100fF and a VL consisting of the amino acid sequence of the VL of P1-068761_E32Y_E100fF;
(aaa) a VH consisting of the amino acid sequence of the VH of P1-068767_D52N_D102V and a VL consisting of the amino acid sequence of the VL of P1-068767_D52N_D102V;
(bbb) a VH consisting of the amino acid sequence of the VH of P1-068767_D52N and a VL consisting of the amino acid sequence of the VL of P1-068767_D52N;
(ccc) a VH consisting of the amino acid sequence of the VH of P1-068767_D52N_E55A and a VL consisting of the amino acid sequence of the VL of P1-068767_D52N_E55A;
(ddd) a VH consisting of the amino acid sequence of the VH of P1-068767_E55A_D102V and a VL consisting of the amino acid sequence of the VL of P1-068767_E55A_D102V;
(eee) a VH consisting of the amino acid sequence of the VH of P1-068767_D102V and a VL consisting of the amino acid sequence of the VL of P1-068767-D102V;
(fff) a VH consisting of the amino acid sequence of the VH of P1-068767_E55A and a VL consisting of the amino acid sequence of the VL of P1-068767_E55A;
(ggg) a VH consisting of the amino acid sequence of the VH of P1-068767_E30D_D52N and a VL consisting of the amino acid sequence of the VL of P1-068767_E30D_D52N;
(hhh) a VH consisting of the amino acid sequence of the VH of P1-068767_E30D_D102V and a VL consisting of the amino acid sequence of the VL of P1-068767-E30D_D102V;
(iii) a VH consisting of the amino acid sequence of the VH of P1-068767_E30D and a VL consisting of the amino acid sequence of the VL of P1-068767_E30D;
(jjj) a VH consisting of the amino acid sequence of the VH of P1-068767_E30D_E55A and a VL consisting of the amino acid sequence of the VL of P1-068767 E30D_E55A;
(kkk) a VH consisting of the amino acid sequence of the VH of P1-068767_E100fF_D102V and a VL consisting of the amino acid sequence of the VL of P1-068767_E100fF_D102V;
(lll) a VH consisting of the amino acid sequence of the VH of P1-068767_E55A_E100fF and a VL consisting of the amino acid sequence of the VL of P1-068767_E55A_E100fF;
(mmm) a VH consisting of the amino acid sequence of the VH of P1-068767_D52N_E100fF and a VL consisting of the amino acid sequence of the VL of P1-068767_D52N_E100fF;
(nnn) a VH consisting of the amino acid sequence of the VH of P1-068767_E100fF and a VL consisting of the amino acid sequence of the VL of P1-068767_E100fF;
(ooo) a VH consisting of the amino acid sequence of the VH of P1-068767_E30D_E100fF and a VL consisting of the amino acid sequence of the VL of P1-068767 E30D E100fF;
(ppp) a VH consisting of the amino acid sequence of the VH of P1-061029_F100fE_V102D and a VL consisting of the amino acid sequence of the VL of P1-061029_F100fE_V102D;
(qqq) a VH consisting of the amino acid sequence of the VH of P1-061029_F100fE and a VL consisting of the amino acid sequence of the VL of P1-061029_F100fE;
(rrr) a VH consisting of the amino acid sequence of the VH of P1-061029_V102D and a VL consisting of the amino acid sequence of the VL of P1-061029_V102D;
(sss) a VH consisting of the amino acid sequence of the VH of P1-061029_Y32E and a VL consisting of the amino acid sequence of the VL of P1-061029_Y32E; or
(ttt) a VH consisting of the amino acid sequence of the VH of P1-061029_Y32E_F100fE and a VL consisting of the amino acid sequence of the VL of P1-061029 Y32E_F100fE;
optionally wherein the VH in any of (a) to (ttt) comprises one or both of the K16R and T84A substitutions.

In certain embodiments, an anti-VISTA Ab comprises any of the variable regions and/or variable region CDRs 1-3 of the antibodies described above and elsewhere herein, such as:
(1) one or more of VH CDR1, CDR2 and CDR3 of:
(2) the VH CDR1, CDR2 and CDR3 of:
(3) the VH of:
(4) one or more of VH CDR1, CDR2 and CDR3 and one or more of VL CDR1, CDR2 and CDR3 of:
(5) the VH CDR1, CDR2 and CDR3 and VL CDR1, CDR2 and CDR3 of:
(6) the VH and the VLs of:
or
(7) the VL and the VH, with the exception of one or both of K16R and T84A substitutions in the VH (in the case of P1-061029 or its progeny), of:
P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075, P1-069077, P1-061015, P1-068736, P1-068738, P1-068740, P1-068742, P1-068744, P1-068766, P1-068748, P1-068750, P1-068752 P1-068754, P1-068761_E55A, P1-068761_H100G, P1-068761_E56N, P1-068761_E55A_E56N, P1-068761_E30D, P1-068761_E30D_E55A, P1-068761_E56N_H100G, P1-068761_E30D_H100G, P1-068761_E30D_E56N, P1-068761_E100fF, P1-068761_E55A_E100fF, P1-068761_H100G_E100fF, P1-068761_E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, P1-068761_E32Y_E100fF, P1-068767 D52N_D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767_E100fF, P1-068767_E30D_E100fF, P1-061029_F100fE_V102D, P1-061029_F100fE, P1-061029_V102D, P1-061029_Y32E, or P1-061029_Y32E_F100fE; and the anti-VISTA Ab is also an IgG antibody, such as IgG1, IgG2, IgG3 or IgG4 antibody or a modified form thereof as described in the section below. In some embodiments, the constant region has effector function, and in some embodiments, the constant region is effectorless. In certain embodiments, the constant region is that of IgG1.3.

In certain embodiments, an anti-VISTA Ab comprises any of the variable regions and/or variable region CDRs 1-3 of the antibodies described above and elsewhere herein, such as:
(1) one or more of VH CDR1, CDR2 and CDR3 of:
(2) the VH CDR1, CDR2 and CDR3 of:
(3) the VH of:
(4) one or more of VH CDR1, CDR2 and CDR3 and one or more of VL CDR1, CDR2 and CDR3 of:
(5) the VH CDR1, CDR2 and CDR3 and VL CDR1, CDR2 and CDR3 of:
(6) the VH and the VLs of:
or
(7) the VL and the VH, with the exception of one or both of K16R and T84A substitutions in the VH (in the case of P1-061029 and it progeny), of:
P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075, P1-069077, P1-061015, P1-068736, P1-068738, P1-068740, P1-068742, P1-068744, P1-068766, P1-068748, P1-068750, P1-068752 P1-068754, P1-068761_E55A, P1-068761_H100G, P1-068761_E56N, P1-068761_E55A_E56N, P1-068761_E30D, P1-068761_E30D_E55A, P1-068761_E56N_H100G, P1-068761_E30D_H100G, P1-068761_E30D_E56N, P1-068761_E100fF, P1-068761_E55A_E100fF, P1-068761_H100G_E100fF, P1-068761_E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, P1-068761_E32Y_E100fF, P1-068767 D52N_D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767_E100fF, P1-068767_E30D_E100fF, P1-061029_F100fE_V102D, P1-061029_F100fE, P1-061029_V102D, P1-061029 Y32E, or P1-061029_Y32E_F100fE,
and further comprises one or more of the following characteristics:
specifically binding to hVISTA, e.g., histidine rich region of the ECD or a polypeptide comprising amino acid residues 35-127 of SEQ ID NO: 2, at acidic pH, e.g., pH 6.0 or pH 6.5;

lacking of significant binding to hVISTA, e.g., histidine rich region of the ECD or a polypeptide comprising amino acid residues 35-127 of SEQ ID NO: 2, at physiological pH or neutral pH, e.g., pH 7.4 or pH 7.0;

specifically binding to cyno VISTA, e.g., histidine rich region of the ECD, at acidic pH, e.g., pH 6.0 or pH 6.5;

lacking of significant binding to cyno VISTA, e.g., histidine rich region of the ECD, at physiological pH or neutral pH, e.g., pH 7.4 or pH 7.0;

having reduced binding to hVISTA-ECD having a substitution at one or more of the following amino acids: T35, Y37, K38, T39, Y41, R54, T61, F62, Q63, L65, H66, L67, H68, H69, F97, L115, V117, I119, H121, H122, S124, E125, R127 relative to hVISTA ECD having SEQ ID NO: 2;

cross-competing for binding to hVISTA with P1-061029, P1-068761, P1-068767 and/or P1-061015;

inhibiting binding of hVISTA to human T cells expressing VISTA (e.g., naïve or activated T cells) at acidic pH e.g., pH 6.0 or pH 6.5;

inhibiting binding of hVISTA to PSGL-1 at acidic pH e.g., pH 6.0 or pH 6.5 (e.g., inhibiting the interaction between H153 and H154 of hVISTA having SEQ ID NO: 1 and PSGL-1 tyrosines Y46 and Y48), wherein PSGL-1 is with or without siayl lewis X, and wherein the tyrosines are preferably sulfotyrosines;

a mean residence time (MRT) of at least 100, 200, 300, 350, 400, 450, 500, 600 or 700 hours (e.g., at least 350 hours) in cynomolgus monkeys, measured, e.g, as described in the Examples;

stimulating T cell activation by, e.g., enhancing T cell proliferation; enhancing IFN-γ production from T cells; and/or stimulating T cell receptor mediated NF-kB signaling;

inhibiting VISTA mediated cell:cell adhesion;

specifically binding to hVISTA in samples of human tumor cells or samples of inflamed human tissue that express VISTA;

contacting hVISTA through one or more (e.g., at least 1-3, 1-5, 1-10, 5-10, 5-15 or all) energetically important contact residues Y37, T39, R54, F62, H66, V117, I119 or S124, as determined, e.g., using the yeast surface display and NGS assay described in Example 15; and wherein numbering is that of mature hVISTA;

binding to Region 1: $_{57}$LGPVDKGHDVTF$_{68}$; Region 2: $_{86}$RRPIRNLTFQDL$_{97}$; and Region 3: $_{148}$VVEIRHHHSEHRVHGAME$_{165}$ of hVISTA having SEQ ID NO: 1, and optionally wherein the binding is strongest to Region 2, as determined by MS-HDX as described in Example 21;

binding to the histidine-rich β-sheet extension of hVISTA, as determined, e.g., by crystallography, as described, e.g., in the Examples;

contacting H121, H122 and/or H123 of mature hVISTA (distance of 4.0 Ångströms (Å) or less), such as through hydrogen bonds, as determined, e.g., by crystallography, as described, e.g., in the Examples;

contacting hVISTA through at least one or more glutamic acid, aspartic acid or histidine residue that is located in VH CDR1, CDR2 or CDR3; and and any additional characteristic set forth in the claims and/or in the Examples.

In certain embodiments, an anti-hVISTA Ab comprises a heavy chain (HC) comprising the amino acid sequence of the heavy chain of any of the anti-hVISTA Abs provided herein. In certain embodiments, an anti-hVISTA Ab comprises a heavy chain comprising the amino acid sequence of the heavy chain of P1-061029 or P1-061015 or progeny thereof, as shown below in the Sequence Table, comprising an IgG1.3 heavy chain constant region, such as P1-061029.IgG1.3 (SEQ ID NO: 69), P1-068757.IgG1.3, P1-068759.IgG1.3, P1-068761.IgG1.3, P1-068763.IgG1.3, P1-068765.IgG1.3, P1-068767.IgG1.3, P1-068769.IgG1.3, P1-068771.IgG1.3, P1-068773.IgG1.3, P1-068775.IgG1.3, P1-069059.IgG1.3, P1-069061.IgG1.3, P1-069063.IgG1.3, P1-069065.IgG1.3, P1-069067.IgG1.3, P1-069069.IgG1.3, P1-069071.IgG1.3, P1-069073.IgG1.3, P1-069075.IgG1.3, P1-069077.IgG1.3, P1-061015.IgG1.3, P1-068736.IgG1.3, P1-068738.IgG1.3, P1-068740.IgG1.3, P1-068742.IgG1.3, P1-068744.IgG1.3, P1-068766.IgG1.3, P1-068748.IgG1.3, P1-068750.IgG1.3, P1-068752.IgG1.3, P1-068754.IgG1.3, P1-068761_E55A.IgG1.3, P1-068761_H100G.IgG1.3, P1-068761_E56N.IgG1.3, P1-068761_E55A_E56N.IgG1.3, P1-068761_E30D.IgG1.3, P1-068761_E30D_E55A.IgG1.3, P1-068761_E56N_H100G.IgG1.3, P1-068761_E30D_H100G.IgG1.3, P1-068761_E30D_E56N.IgG1.3, P1-068761_E100fF.IgG1.3, P1-068761_E55A_E100fF.IgG1.3, P1-068761_H100G_E100fF.IgG1.3, P1-068761_E30D_E100fF.IgG1.3, P1-068761_E56N_E100fF.IgG1.3, P1-068761_E32Y.IgG1.3, P1-068761_E32Y_E55A.IgG1.3, P1-068761_E32Y_E56N.IgG1.3, P1-068761_E30D_E32Y.IgG1.3, P1-068761_E32Y_H100G.IgG1.3, P1-068761_E32Y_E100fF.IgG1.3, P1-068767_D52N_D102V.IgG1.3, P1-068767_D52N.IgG1.3, P1-068767_D52N_E55A.IgG1.3, P1-068767_E55A_D102V.IgG1.3, P1-068767_D102V.IgG1.3, P1-068767_E55A.IgG1.3, P1-068767_E30D_D52N.IgG1.3, P1-068767__E30D_D102V.IgG1.3, P1-068767_E30D.IgG1.3, P1-068767-E30D_E55A.IgG1.3, P1-068767_E100fF_D102V.IgG1.3, P1-068767_E55A_E100fF.IgG1.3, P1-068767_D52N_E100fF.IgG1.3, P1-068767_E100fF.IgG1.3, P1-068767_E30D_E100fF.IgG1.3, P1-061029__F100fE_V102D.IgG1.3, P1-061029_F100fE.IgG1.3, P1-061029__V102D.IgG1.3, P1-061029_Y32E.IgG1.3, or P1-061029_Y32E_F100fE.IgG1.3, optionally wherein the VH comprise one or both of the K16R and T84A substitutions.

In certain embodiments, an anti-hVISTA Ab comprises a heavy chain comprising the amino acid sequence of the heavy chain of any of the anti-hVISTA Abs provided herein, which comprise an IgG1.3 heavy chain constant region, and the amino acid sequence of the light chain of any of the anti-hVISTA Abs provided herein. In certain embodiments, an anti-hVISTA Ab comprises a heavy chain comprising the amino acid sequence of the VH of P1-061029 or P1-061015 or progeny thereof, which comprise an IgG1.3 HC constant region, such as P1-061029.IgG1.3 (SEQ ID NO: 69), P1-068757.IgG1.3, P1-068759.IgG1.3, P1-068761.IgG1.3, P1-068763.IgG1.3, P1-068765.IgG1.3, P1-068767.IgG1.3,
P1-068769.IgG1.3, P1-068771.IgG1.3, P1-068773.IgG1.3,
P1-068775.IgG1.3, P1-069059.IgG1.3, P1-069061.IgG1.3,
P1-069063.IgG1.3, P1-069065.IgG1.3, P1-069067.IgG1.3,
P1-069069.IgG1.3, P1-069071.IgG1.3, P1-069073.IgG1.3,
P1-069075.IgG1.3, P1-069077.IgG1.3, P1-061015.IgG1.3,
P1-068736.IgG1.3, P1-068738.IgG1.3, P1-068740.IgG1.3,
P1-068742.IgG1.3, P1-068744.IgG1.3, P1-068766.IgG1.3,
P1-068748.IgG1.3, P1-068750.IgG1.3, P1-068752.IgG1.3,
P1-068754.IgG1.3, P1-068761_E55A.IgG1.3,
P1-068761_H100G.IgG1.3, P1-068761_E56N.IgG1.3,
P1-068761_E55A_E56N.IgG1.3,
P1-068761_E30D.IgG1.3,
P1-068761_E30D_E55A.IgG1.3,
P1-068761_E56N_H100G.IgG1.3,
P1-068761_E30D_H100G.IgG1.3,
P1-068761_E30D_E56N.IgG1.3,
P1-068761_E100fF.IgG1.3, P1-068761-
E55A_E100fF.IgG1.3, P1-068761_H100G_E100fF.IgG1.3,
P1-068761_E30D_E100fF.IgG1.3,
P1-068761_E56N_E100fF.IgG1.3,
P1-068761_E32Y.IgG1.3, P1-068761_E32Y_E55A.IgG1.3,
P1-068761_E32Y_E56N.IgG1.3,
P1-068761_E30D_E32Y.IgG1.3,
P1-068761_E32Y_H100G.IgG1.3,
P1-068761_E32Y_E100fF.IgG1.3,
P1-068767_D52N_D102V.IgG1.3,
P1-068767_D52N.IgG1.3,
P1-068767_D52N_E55A.IgG1.3,
P1-068767_E55A_D102V.IgG1.3, P1-068767
D102V.IgG1.3, P1-068767_E55A.IgG1.3,
P1-068767_E30D_D52N.IgG1.3,
P1-068767_E30D_D102V.IgG1.3,
P1-068767_E30D.IgG1.3,
P1-068767_E30D_E55A.IgG1.3,
P1-068767_E100fF_D102V.IgG1.3, P1-068767_E55A
E100fF.IgG1.3, P1-068767_D52N_E100fF.IgG1.3,
P1-068767_E100fF.IgG1.3,
P1-068767_E30D_E100fF.IgG1.3,
P1-061029_F100fE_V102D.IgG1.3,
P1-061029_F100fE.IgG1.3, P1-061029_V102D.IgG1.3,
P1-061029_Y32E.IgG1.3, or
P1-061029_Y32E_F100fE.IgG1.3, optionally wherein the
VH comprise one or both of the K16R and T84A substitutions; and a light chain comprising the amino acid sequence
of the light chain of P1-061029 or P1-061015.

An anti-hVISTA Ab may comprise:
(a) a heavy chain comprising the amino acid sequence of
the heavy chain of P1-061029.IgG1.3 (SEQ ID NO: 69)
and a light chain comprising the light chain amino acid
sequence of P1-061029 (SEQ ID NO: 70);
(b) a heavy chain comprising the amino acid sequence of
the heavy chain of P1-061015.IgG1.3 and a light chain
comprising the light chain amino acid sequence of
P1-061015;
(c) a heavy chain comprising the amino acid sequence of
the heavy chain of P1-068757.IgG1.3 and a light chain
comprising the light chain amino acid sequence of
P1-068757;
(d) a heavy chain comprising the amino acid sequence of
the heavy chain of P1-068759.IgG1.3 and a light chain
comprising the light chain amino acid sequence of
P1-068759;
(e) a heavy chain comprising the amino acid sequence of
the heavy chain of P1-068761.IgG1.3 and a light chain
comprising the light chain amino acid sequence of
P1-068761;
(f) a heavy chain comprising the amino acid sequence of
the heavy chain of P1-068763.IgG1.3 and a light chain
comprising the light chain amino acid sequence of
P1-068763;
(g) a heavy chain comprising the amino acid sequence of
the heavy chain of P1-068765.IgG1.3 and a light chain
comprising the light chain amino acid sequence of
P1-068765;
(h) a heavy chain comprising the amino acid sequence of
the heavy chain of P1-068767.IgG1.3 and a light chain
comprising the light chain amino acid sequence of
P1-068767;
(i) a heavy chain comprising the amino acid sequence of
the heavy chain of P1-068769.IgG1.3 and a light chain
comprising the light chain amino acid sequence of
P1-068769;
(j) a heavy chain comprising the amino acid sequence of
the heavy chain of P1-068771.IgG1.3 and a light chain
comprising the light chain amino acid sequence of
P1-068771;
(k) a heavy chain comprising the amino acid sequence of
the heavy chain of P1-068773.IgG1.3 and a light chain
comprising the light chain amino acid sequence of
P1-068773;
(l) a heavy chain comprising the amino acid sequence of
the heavy chain of P1-068775.IgG1.3 and a light chain
comprising the light chain amino acid sequence of
P1-068775;
(m) a heavy chain comprising the amino acid sequence of
the heavy chain of P1-069059.IgG1.3 and a light chain
comprising the light chain amino acid sequence of
P1-069059;
(n) a heavy chain comprising the amino acid sequence of
the heavy chain of P1-069061.IgG1.3 and a light chain
comprising the light chain amino acid sequence of
P1-069061;
(o) a heavy chain comprising the amino acid sequence of
the heavy chain of P1-069063.IgG1.3 and a light chain
comprising the light chain amino acid sequence of
P1-069063;
(p) a heavy chain comprising the amino acid sequence of
the heavy chain of P1-069065.IgG1.3 and a light chain
comprising the light chain amino acid sequence of
P1-069065;
(q) a heavy chain comprising the amino acid sequence of
the heavy chain of P1-069067.IgG1.3 and a light chain
comprising the light chain amino acid sequence of
P1-069067;
(r) a heavy chain comprising the amino acid sequence of
the heavy chain of P1-069069.IgG1.3 and a light chain
comprising the light chain amino acid sequence of
P1-069069;
(s) a heavy chain comprising the amino acid sequence of
the heavy chain of P1-069071.IgG1.3 and a light chain
comprising the light chain amino acid sequence of
P1-069071;
(t) a heavy chain comprising the amino acid sequence of
the heavy chain of P1-069073.IgG1.3 and a light chain
comprising the light chain amino acid sequence of
P1-069073;
(u) a heavy chain comprising the amino acid sequence of
the heavy chain of P1-069075.IgG1.3 and a light chain
comprising the light chain amino acid sequence of
P1-069075;

(v) a heavy chain comprising the amino acid sequence of the heavy chain of P1-069077.IgG1.3 and a light chain comprising the light chain amino acid sequence of P1-069077;

(w) a heavy chain comprising the amino acid sequence of the heavy chain of P1-068736.IgG1.3 and a light chain comprising the light chain amino acid sequence of P1-068736;

(x) a heavy chain comprising the amino acid sequence of the heavy chain of P1-068738.IgG1.3 and a light chain comprising the light chain amino acid sequence of P1-068738;

(y) a heavy chain comprising the amino acid sequence of the heavy chain of P1-068740.IgG1.3 and a light chain comprising the light chain amino acid sequence of P1-068740;

(z) a heavy chain comprising the amino acid sequence of the heavy chain of P1-068742.IgG1.3 and a light chain comprising the light chain amino acid sequence of P1-068742;

(aa) a heavy chain comprising the amino acid sequence of the heavy chain of P1-068744.IgG1.3 and a light chain comprising the light chain amino acid sequence of P1-068744;

(bb) a heavy chain comprising the amino acid sequence of the heavy chain f P1-068746.IgG1.3 and a light chain comprising the light chain amino acid sequence of P1-068746;

(cc) a heavy chain comprising the amino acid sequence of the heavy chain of P1-068748.IgG1.3 and a light chain comprising the light chain amino acid sequence of P1-068748;

(dd) a heavy chain comprising the amino acid sequence of the heavy chain of P1-068750.IgG1.3 and a light chain comprising the light chain amino acid sequence of P1-068750;

(ee) a heavy chain comprising the amino acid sequence of the heavy chain of P1-068752.IgG1.3 and a light chain comprising the light chain amino acid sequence of P1-068752;

(ff) a heavy chain comprising the amino acid sequence of the heavy chain of P1-068754.IgG1.3 and a light chain comprising the light chain amino acid sequence of P1-068754;

(gg) a heavy chain comprising the amino acid sequence of the heavy chain of P1-068761-E55A.IgG1.3 and a light chain comprising the light chain amino acid sequence of P1-068761_E55A;

(hh) a heavy chain comprising the amino acid sequence of the heavy chain of P1-068761_H100G.IgG1.3 and a light chain comprising the light chain amino acid sequence of P1-068761_H100G;

(ii) a heavy chain comprising the amino acid sequence of the heavy chain of P1-068761_E56N.IgG1.3 and a light chain comprising the light chain amino acid sequence of P1-068761_E56N;

(jj) a heavy chain comprising the amino acid sequence of the heavy chain of P1-068761_E55A_E56N.IgG1.3 and a light chain comprising the light chain amino acid sequence of P1-068761_E55A_E56N;

(kk) a heavy chain comprising the amino acid sequence of the heavy chain of P1-068761_E30D.IgG1.3 and a light chain comprising the light chain amino acid sequence of P1-068761_E30D;

(ll) a heavy chain comprising the amino acid sequence of the heavy chain of P1-068761_E30D_E55A.IgG1.3 and a light chain comprising the light chain amino acid sequence of P1-068761_E30D_E55A;

(mm) a heavy chain comprising the amino acid sequence of the heavy chain of P1-068761_E56N_H100G.IgG1.3 and a light chain comprising the light chain amino acid sequence of P1-068761_E56N_H100G;

(nn) a heavy chain comprising the amino acid sequence of the heavy chain of P1-068761_E30D_H100G.IgG1.3 and a light chain comprising the light chain amino acid sequence of P1-068761_E30D_H100G;

(oo) a heavy chain comprising the amino acid sequence of the heavy chain of P1-068761_E30D_E56N.IgG1.3 and a light chain comprising the light chain amino acid sequence of P1-068761_E30D_E56N;

(pp) a heavy chain comprising the amino acid sequence of the heavy chain of P1-068761_E100fF.IgG1.3 and a light chain comprising the light chain amino acid sequence of P1-068761_E100fF;

(qq) a heavy chain comprising the amino acid sequence of the heavy chain of P1-068761_E55A_E100fF.IgG1.3 and a light chain comprising the light chain amino acid sequence of P1-068761_E55A_E100fF;

(rr) a heavy chain comprising the amino acid sequence of the heavy chain of P1-068761_H100G_E100fF.IgG1.3 and a light chain comprising the light chain amino acid sequence of P1-068761_H100G_E100fF;

(ss) a heavy chain comprising the amino acid sequence of the heavy chain of P1-068761_E30D_E100fF.IgG1.3 and a light chain comprising the light chain amino acid sequence of P1-068761_E30D_E100fF;

(tt) a heavy chain comprising the amino acid sequence of the heavy chain of P1-068761_E56N_E100fF.IgG1.3 and a light chain comprising the light chain amino acid sequence of P1-068761_E56N_E100fF;

(uu) a heavy chain comprising the amino acid sequence of the heavy chain of P1-068761_E32Y.IgG1.3 and a light chain comprising the light chain amino acid sequence of P1-068761_E32Y;

(vv) a heavy chain comprising the amino acid sequence of the heavy chain of P1-068761_E32Y_E55A.IgG1.3 and a light chain comprising the light chain amino acid sequence of P1-068761_E32Y_E55A;

(ww) a heavy chain comprising the amino acid sequence of the heavy chain of P1-068761_E32Y_E56N.IgG1.3 and a light chain comprising the light chain amino acid sequence of P1-068761_E32Y_E56N;

(xx) a heavy chain comprising the amino acid sequence of the heavy chain of P1-068761_E30D_E32Y.IgG1.3 and a light chain comprising the light chain amino acid sequence of P1-068761_E30D_E32Y;

(yy) a heavy chain comprising the amino acid sequence of the heavy chain of P1-068761_E32Y_H100G.IgG1.3 and a light chain comprising the light chain amino acid sequence of P1-068761_E32Y_H100G;

(zz) a heavy chain comprising the amino acid sequence of the heavy chain of P1-068761_E32Y_E100fF.IgG1.3 and a light chain comprising the light chain amino acid sequence of P1-068761_E32Y_E100fF;

(aaa) a heavy chain comprising the amino acid sequence of the heavy chain of P1-068767 D52N_D102V.IgG1.3 and a light chain comprising the light chain amino acid sequence of P1-068767_D52N_D102V;

(bbb) a heavy chain comprising the amino acid sequence of the heavy chain of P1-068767_D52N.IgG1.3 and a light chain comprising the light chain amino acid sequence of P1-068767_D52N;

(ccc) a heavy chain comprising the amino acid sequence of the heavy chain of P1-068767_D52N_E55A.IgG1.3 and a light chain comprising the light chain amino acid sequence of P1-068767_D52N_E55A;
(ddd) a heavy chain comprising the amino acid sequence of the heavy chain of P1-068767_E55A_D102V.IgG1.3 and a light chain comprising the light chain amino acid sequence of P1-068767 E55A_D102V;
(eee) a heavy chain comprising the amino acid sequence of the heavy chain of P1-068767_D102V.IgG1.3 and a light chain comprising the light chain amino acid sequence of P1-068767_D102V;
(fff) a heavy chain comprising the amino acid sequence of the heavy chain of P1-068767_E55A.IgG1.3 and a light chain comprising the light chain amino acid sequence of P1-068767_E55A;
(ggg) a heavy chain comprising the amino acid sequence of the heavy chain of P1-068767_E30D_D52N.IgG1.3 and a light chain comprising the light chain amino acid sequence of P1-068767_E30D_D52N;
(hhh) a heavy chain comprising the amino acid sequence of the heavy chain of P1-068767_E30D_D102V.IgG1.3 and a light chain comprising the light chain amino acid sequence of P1-068767_E30D_D102V;
(iii) a heavy chain comprising the amino acid sequence of the heavy chain of P1-068767_E30D.IgG1.3 and a light chain comprising the light chain amino acid sequence of P1-068767_E30D;
(jjj) a heavy chain comprising the amino acid sequence of the heavy chain of P1-068767_E30D_E55A.IgG1.3 and a light chain comprising the light chain amino acid sequence of P1-068767_E30D_E55A;
(kkk) a heavy chain comprising the amino acid sequence of the heavy chain of P1-068767_E100fF_D102V.IgG1.3 and a light chain comprising the light chain amino acid sequence of P1-068767_E100fF_D102V;
(lll) a heavy chain comprising the amino acid sequence of the heavy chain of P1-068767_E55A_E100fF.IgG1.3 and a light chain comprising the light chain amino acid sequence of P1-068767_E55A_E100fF;
(mmm) a heavy chain comprising the amino acid sequence of the heavy chain of P1-068767_D52N_E100fF.IgG1.3 and a light chain comprising the light chain amino acid sequence of P1-068767_D52N_E100fF;
(nnn) a heavy chain comprising the amino acid sequence of the heavy chain of P1-068767_E100fF.IgG1.3 and a light chain comprising the light chain amino acid sequence of P1-068767_E100fF; or
(ooo) a heavy chain comprising the amino acid sequence of the heavy chain of P1-068767_E30D_E100fF.IgG1.3 and a light chain comprising the light chain amino acid sequence of P1-068767_E30D_E100fF.
(ppp) a heavy chain comprising the amino acid sequence of the heavy chain of P1-061029_F100fE_V102D and a light chain comprising the light chain amino acid sequence of P1-061029° F.100fE_V102D;
(qqq) a heavy chain comprising the amino acid sequence of the heavy chain of P1-061029_F100fE.IgG1.3 and a light chain comprising the light chain amino acid sequence of P1-061029_F100fE;
(rrr) a heavy chain comprising the amino acid sequence of the heavy chain of P1-061029_V102D.IgG1.3 and a light chain comprising the light chain amino acid sequence of P1-061029_V102D;
(sss) a heavy chain comprising the amino acid sequence of the heavy chain of P1-061029_Y32E.IgG1.3 and a light chain comprising the light chain amino acid sequence of P1-061029_Y32E; or
(ttt) a heavy chain comprising the amino acid sequence of the heavy chain of P1-061029_Y32E_F100fE.IgG1.3 and a light chain comprising the light chain amino acid sequence of P1-061029_Y32E_F100fE;
optionally wherein the VH in any of (a) to (ttt) comprises one or both of the K16R and T84A substitutions.

An anti-hVISTA Ab may comprise:
(a) a heavy chain (HC) comprising the HC CDRs of the HC of P1-061029 and a light chain (LC) comprising the LC CDRs of P1-061029 and HC and LC amino acid sequences that are at least 90%, at least 91%, at least 92%, at least 93%, at least 94%, at least 95%, at least 96%, at least 97%, at least 98%, or at least 99% identical to the HC and LC of P1-061029.IgG1.3, respectively;
(b) a HC comprising the HC CDRs of the HC of P1-061015 and a LC comprising the LC CDRs of P1-061015 and HC and LC amino acid sequences that are at least 90%, at least 91%, at least 92%, at least 93%, at least 94%, at least 95%, at least 96%, at least 97%, at least 98%, or at least 99% identical to the HC and LC of P1-061015.IgG1.3, respectively;
(c) a HC comprising the HC CDRs of the HC of P1-068757 and a LC comprising the LC CDRs of P1-068757 and HC and LC amino acid sequences that are at least 90%, at least 91%, at least 92%, at least 93%, at least 94%, at least 95%, at least 96%, at least 97%, at least 98%, or at least 99% identical to the HC and LC of P1-068757.IgG1.3, respectively;
(d) a HC comprising the HC CDRs of the HC of P1-068759 and a LC comprising the LC CDRs of P1-068759 and HC and LC amino acid sequences that are at least 90%, at least 91%, at least 92%, at least 93%, at least 94%, at least 95%, at least 96%, at least 97%, at least 98%, or at least 99% identical to the HC and LC of P1-068759.IgG1.3, respectively;
(e) a HC comprising the HC CDRs of the HC of P1-068761 and a LC comprising the LC CDRs of P1-068761 and HC and LC amino acid sequences that are at least 90%, at least 91%, at least 92%, at least 93%, at least 94%, at least 95%, at least 96%, at least 97%, at least 98%, or at least 99% identical to the HC and LC of P1-068761.IgG1.3, respectively;
(f) a HC comprising the HC CDRs of the HC of P1-068763 and a LC comprising the LC CDRs of P1-068763 and HC and LC amino acid sequences that are at least 90%, at least 91%, at least 92%, at least 93%, at least 94%, at least 95%, at least 96%, at least 97%, at least 98%, or at least 99% identical to the HC and LC of P1-068763.IgG1.3, respectively;
(g) a HC comprising the HC CDRs of the HC of P1-068765 and a LC comprising the LC CDRs of P1-068765 and HC and LC amino acid sequences that are at least 90%, at least 91%, at least 92%, at least 93%, at least 94%, at least 95%, at least 96%, at least 97%, at least 98%, or at least 99% identical to the HC and LC of P1-068765.IgG1.3, respectively;
(h) a HC comprising the HC CDRs of the HC of P1-068767 and a LC comprising the LC CDRs of P1-068767 and HC and LC amino acid sequences that are at least 90%, at least 91%, at least 92%, at least 93%, at least 94%, at least 95%, at least 96%, at least 97%, at least 98%, or at least 99% identical to the HC and LC of P1-068767.IgG1.3, respectively;

(i) a HC comprising the HC CDRs of the HC of P1-068769 and a LC comprising the LC CDRs of P1-068769 and HC and LC amino acid sequences that are at least 90%, at least 91%, at least 92%, at least 93%, at least 94%, at least 95%, at least 96%, at least 97%, at least 98%, or at least 99% identical to the HC and LC of P1-068769.IgG1.3, respectively;

(j) a HC comprising the HC CDRs of the HC of P1-068771 and a LC comprising the LC CDRs of P1-068771 and HC and LC amino acid sequences that are at least 90%, at least 91%, at least 92%, at least 93%, at least 94%, at least 95%, at least 96%, at least 97%, at least 98%, or at least 99% identical to the HC and LC of P1-068771.IgG1.3, respectively;

(k) a HC comprising the HC CDRs of the HC of P1-068773 and a LC comprising the LC CDRs of P1-068773 and HC and LC amino acid sequences that are at least 90%, at least 91%, at least 92%, at least 93%, at least 94%, at least 95%, at least 96%, at least 97%, at least 98%, or at least 99% identical to the HC and LC of P1-068773.IgG1.3, respectively;

(l) a HC comprising the HC CDRs of the HC of P1-068775 and a LC comprising the LC CDRs of P1-068775 and HC and LC amino acid sequences that are at least 90%, at least 91%, at least 92%, at least 93%, at least 94%, at least 95%, at least 96%, at least 97%, at least 98%, or at least 99% identical to the HC and LC of P1-068775.IgG1.3, respectively;

(m) a HC comprising the HC CDRs of the HC of P1-069059 and a LC comprising the LC CDRs of P1-069059 and HC and LC amino acid sequences that are at least 90%, at least 91%, at least 92%, at least 93%, at least 94%, at least 95%, at least 96%, at least 97%, at least 98%, or at least 99% identical to the HC and LC of P1-069059.IgG1.3, respectively;

(n) a HC comprising the HC CDRs of the HC of P1-069061 and a LC comprising the LC CDRs of P1-069061 and HC and LC amino acid sequences that are at least 90%, at least 91%, at least 92%, at least 93%, at least 94%, at least 95%, at least 96%, at least 97%, at least 98%, or at least 99% identical to the HC and LC of P1-069061.IgG1.3, respectively;

(o) a HC comprising the HC CDRs of the HC of P1-069063 and a LC comprising the LC CDRs of P1-069063 and HC and LC amino acid sequences that are at least 90%, at least 91%, at least 92%, at least 93%, at least 94%, at least 95%, at least 96%, at least 97%, at least 98%, or at least 99% identical to the HC and LC of P1-069063.IgG1.3, respectively;

(p) a HC comprising the HC CDRs of the HC of P1-069065 and a LC comprising the LC CDRs of P1-069065 and HC and LC amino acid sequences that are at least 90%, at least 91%, at least 92%, at least 93%, at least 94%, at least 95%, at least 96%, at least 97%, at least 98%, or at least 99% identical to the HC and LC of P1-069065.IgG1.3, respectively;

(q) a HC comprising the HC CDRs of the HC of P1-069067 and a LC comprising the LC CDRs of P1-069067 and HC and LC amino acid sequences that are at least 90%, at least 91%, at least 92%, at least 93%, at least 94%, at least 95%, at least 96%, at least 97%, at least 98%, or at least 99% identical to the HC and LC of P1-069067.IgG1.3, respectively;

(r) a HC comprising the HC CDRs of the HC of P1-069069 and a LC comprising the LC CDRs of P1-069069 and HC and LC amino acid sequences that are at least 90%, at least 91%, at least 92%, at least 93%, at least 94%, at least 95%, at least 96%, at least 97%, at least 98%, or at least 99% identical to the HC and LC of P1-069069.IgG1.3, respectively;

(s) a HC comprising the HC CDRs of the HC of P1-069071 and a LC comprising the LC CDRs of P1-069071 and HC and LC amino acid sequences that are at least 90%, at least 91%, at least 92%, at least 93%, at least 94%, at least 95%, at least 96%, at least 97%, at least 98%, or at least 99% identical to the HC and LC of P1-069071.IgG1.3, respectively;

(t) a HC comprising the HC CDRs of the HC of P1-069073 and a LC comprising the LC CDRs of P1-069073 and HC and LC amino acid sequences that are at least 90%, at least 91%, at least 92%, at least 93%, at least 94%, at least 95%, at least 96%, at least 97%, at least 98%, or at least 99% identical to the HC and LC of P1-069073.IgG1.3, respectively;

(u) a HC comprising the HC CDRs of the HC of P1-069075 and a LC comprising the LC CDRs of P1-069075 and HC and LC amino acid sequences that are at least 90%, at least 91%, at least 92%, at least 93%, at least 94%, at least 95%, at least 96%, at least 97%, at least 98%, or at least 99% identical to the HC and LC of P1-069075.IgG1.3, respectively;

(v) a HC comprising the HC CDRs of the HC of P1-069077 and a LC comprising the LC CDRs of P1-069077 and HC and LC amino acid sequences that are at least 90%, at least 91%, at least 92%, at least 93%, at least 94%, at least 95%, at least 96%, at least 97%, at least 98%, or at least 99% identical to the HC and LC of P1-069077.IgG1.3, respectively;

(w) a HC comprising the HC CDRs of the HC of P1-068736 and a LC comprising the LC CDRs of P1-068736 and HC and LC amino acid sequences that are at least 90%, at least 91%, at least 92%, at least 93%, at least 94%, at least 95%, at least 96%, at least 97%, at least 98%, or at least 99% identical to the HC and LC of P1-068736.IgG1.3, respectively;

(x) a HC comprising the HC CDRs of the HC of P1-068738 and a LC comprising the LC CDRs of P1-068738 and HC and LC amino acid sequences that are at least 90%, at least 91%, at least 92%, at least 93%, at least 94%, at least 95%, at least 96%, at least 97%, at least 98%, or at least 99% identical to the HC and LC of P1-068738.IgG1.3, respectively;

(y) a HC comprising the HC CDRs of the HC of P1-068740 and a LC comprising the LC CDRs of P1-068740 and HC and LC amino acid sequences that are at least 90%, at least 91%, at least 92%, at least 93%, at least 94%, at least 95%, at least 96%, at least 97%, at least 98%, or at least 99% identical to the HC and LC of P1-068740.IgG1.3, respectively;

(z) a HC comprising the HC CDRs of the HC of P1-068742 and a LC comprising the LC CDRs of P1-068742 and HC and LC amino acid sequences that are at least 90%, at least 91%, at least 92%, at least 93%, at least 94%, at least 95%, at least 96%, at least 97%, at least 98%, or at least 99% identical to the HC and LC of P1-068742.IgG1.3, respectively;

(aa) a HC comprising the HC CDRs of the HC of P1-068744 and a LC comprising the LC CDRs of P1-068744 and HC and LC amino acid sequences that are at least 90%, at least 91%, at least 92%, at least 93%, at least 94%, at least 95%, at least 96%, at least 97%, at least 98%, or at least 99% identical to the HC and LC of P1-068744.IgG1.3, respectively;

(bb) a HC comprising the HC CDRs of the HC of P1-068746 and a LC comprising the LC CDRs of P1-068746 and HC and LC amino acid sequences that are at least 90%, at least 91%, at least 92%, at least 93%, at least 94%, at least 95%, at least 96%, at least 97%, at least 98%, or at least 99% identical to the HC and LC of P1-068746.IgG1.3, respectively;

(cc) a HC comprising the HC CDRs of the HC of P1-068748 and a LC comprising the LC CDRs of P1-068748 and HC and LC amino acid sequences that are at least 90%, at least 91%, at least 92%, at least 93%, at least 94%, at least 95%, at least 96%, at least 97%, at least 98%, or at least 99% identical to the HC and LC of P1-068748.IgG1.3, respectively;

(dd) a HC comprising the HC CDRs of the HC of P1-068750 and a LC comprising the LC CDRs of P1-068750 and HC and LC amino acid sequences that are at least 90%, at least 91%, at least 92%, at least 93%, at least 94%, at least 95%, at least 96%, at least 97%, at least 98%, or at least 99% identical to the HC and LC of P1-068750.IgG1.3, respectively;

(ee) a HC comprising the HC CDRs of the HC of P1-068752 and a LC comprising the LC CDRs of P1-068752 and HC and LC amino acid sequences that are at least 90%, at least 91%, at least 92%, at least 93%, at least 94%, at least 95%, at least 96%, at least 97%, at least 98%, or at least 99% identical to the HC and LC of P1-068752.IgG1.3, respectively;

(ff) a HC comprising the HC CDRs of the HC of P1-068754 and a LC comprising the LC CDRs of P1-068754 and HC and LC amino acid sequences that are at least 90%, at least 91%, at least 92%, at least 93%, at least 94%, at least 95%, at least 96%, at least 97%, at least 98%, or at least 99% identical to the HC and LC of P1-068754.IgG1.3, respectively;

(gg) a HC comprising the HC CDRs of the HC of P1-068761_E55A.IgG1.3 and a LC comprising the LC CDRs of P1-068761_E55A and HC and LC amino acid sequences that are at least 90%, at least 91%, at least 92%, at least 93%, at least 94%, at least 95%, at least 96%, at least 97%, at least 98%, or at least 99% identical to the HC and LC of P1-068761_E55A.IgG1.3, respectively;

(hh) a HC comprising the HC CDRs of the HC of P1-068761_H100G.IgG1.3 and a LC comprising the LC CDRs of P1-068761_H100G and HC and LC amino acid sequences that are at least 90%, at least 91%, at least 92%, at least 93%, at least 94%, at least 95%, at least 96%, at least 97%, at least 98%, or at least 99% identical to the HC and LC of P1-068761_H100G.IgG1.3, respectively;

(ii) a HC comprising the HC CDRs of the HC of P1-068761_E56N.IgG1.3 and a LC comprising the LC CDRs of P1-068761_E56N and HC and LC amino acid sequences that are at least 90%, at least 91%, at least 92%, at least 93%, at least 94%, at least 95%, at least 96%, at least 97%, at least 98%, or at least 99% identical to the HC and LC of P1-068761_E56N.IgG1.3, respectively;

(jj) a HC comprising the HC CDRs of the HC of P1-068761_E55A_E56N.IgG1.3 and a LC comprising the LC CDRs of P1-068761_E55A_E56N and HC and LC amino acid sequences that are at least 90%, at least 91%, at least 92%, at least 93%, at least 94%, at least 95%, at least 96%, at least 97%, at least 98%, or at least 99% identical to the HC and LC of P1-068761_E55A_E56N.IgG1.3, respectively;

(kk) a HC comprising the HC CDRs of the HC of P1-068761_E30D.IgG1.3 and a LC comprising the LC CDRs of P1-068761_E30D and HC and LC amino acid sequences that are at least 90%, at least 91%, at least 92%, at least 93%, at least 94%, at least 95%, at least 96%, at least 97%, at least 98%, or at least 99% identical to the HC and LC of P1-068761_E30D.IgG1.3, respectively;

(ll) a HC comprising the HC CDRs of the HC of P1-068761_E30D_E55A.IgG1.3 and a LC comprising the LC CDRs of P1-068761_E30D_E55A and HC and LC amino acid sequences that are at least 90%, at least 91%, at least 92%, at least 93%, at least 94%, at least 95%, at least 96%, at least 97%, at least 98%, or at least 99% identical to the HC and LC of P1-068761_E30D_E55A.IgG1.3, respectively;

(mm) a HC comprising the HC CDRs of the HC of P1-068761_E56N_H100G.IgG1.3 and a LC comprising the LC CDRs of P1-068761_E56N_H100G and HC and LC amino acid sequences that are at least 90%, at least 91%, at least 92%, at least 93%, at least 94%, at least 95%, at least 96%, at least 97%, at least 98%, or at least 99% identical to the HC and LC of P1-068761_E56N_H100G.IgG1.3, respectively;

(nn) a HC comprising the HC CDRs of the HC of P1-068761_E30D_H100G.IgG1.3 and a LC comprising the LC CDRs of P1-068761_E30D_H100G and HC and LC amino acid sequences that are at least 90%, at least 91%, at least 92%, at least 93%, at least 94%, at least 95%, at least 96%, at least 97%, at least 98%, or at least 99% identical to the HC and LC of P1-068761_E30D_H100G.IgG1.3, respectively;

(oo) a HC comprising the HC CDRs of the HC of P1-068761_E30D_E56N.IgG1.3 and a LC comprising the LC CDRs of P1-068761_E30D_E56N and HC and LC amino acid sequences that are at least 90%, at least 91%, at least 92%, at least 93%, at least 94%, at least 95%, at least 96%, at least 97%, at least 98%, or at least 99% identical to the HC and LC of P1-068761_E30D_E56N.IgG1.3, respectively;

(pp) a HC comprising the HC CDRs of the HC of P1-068761_E100fF.IgG1.3 and a LC comprising the LC CDRs of P1-068761_E100fF and HC and LC amino acid sequences that are at least 90%, at least 91%, at least 92%, at least 93%, at least 94%, at least 95%, at least 96%, at least 97%, at least 98%, or at least 99% identical to the HC and LC of P1-068761_E100fF.IgG1.3, respectively;

(qq) a HC comprising the HC CDRs of the HC of P1-068761_E55A_E100fF.IgG1.3 and a LC comprising the LC CDRs of P1-068761_E55A_E100fF and HC and LC amino acid sequences that are at least 90%, at least 91%, at least 92%, at least 93%, at least 94%, at least 95%, at least 96%, at least 97%, at least 98%, or at least 99% identical to the HC and LC of P1-068761_E55A_E100fF.IgG1.3, respectively;

(rr) a HC comprising the HC CDRs of the HC of P1-068761_H100G-E100fF.IgG1.3 and a LC comprising the LC CDRs of P1-068761_H100G_E100fF and HC and LC amino acid sequences that are at least 90%, at least 91%, at least 92%, at least 93%, at least 94%, at least 95%, at least 96%, at least 97%, at least 98%, or at least 99% identical to the HC and LC of P1-068761_H100G_E100fF.IgG1.3, respectively;

(ss) a HC comprising the HC CDRs of the HC of P1-068761_E30D_E100fF.IgG1.3 and a LC comprising the LC CDRs of P1-068761_E30D_E100fF and HC and LC amino acid sequences that are at least 90%, at least 91%, at least 92%, at least 93%, at least 94%, at least 95%, at least 96%, at least 97%, at least 98%, or at least 99% identical to the HC and LC of P1-068761-E30D_E100fF.IgG1.3, respectively;

(tt) a HC comprising the HC CDRs of the HC of P1-068761_E56N_E100fF.IgG1.3 and a LC comprising the LC CDRs of P1-068761_E56N_E100fF and HC and LC amino acid sequences that are at least 90%, at least 91%, at least 92%, at least 93%, at least 94%, at least 95%, at least 96%, at least 97%, at least 98%, or at least 99% identical to the HC and LC of P1-068761_E56N-E100fF.IgG1.3, respectively;

(uu) a HC comprising the HC CDRs of the HC of P1-068761_E32Y.IgG1.3 and a LC comprising the LC CDRs of P1-068761_E32Y and HC and LC amino acid sequences that are at least 90%, at least 91%, at least 92%, at least 93%, at least 94%, at least 95%, at least 96%, at least 97%, at least 98%, or at least 99% identical to the HC and LC of P1-068761_E32Y.IgG1.3, respectively;

(vv) a HC comprising the HC CDRs of the HC of P1-068761_E32Y_E55A.IgG1.3 and a LC comprising the LC CDRs of P1-068761_E32Y_E55A and HC and LC amino acid sequences that are at least 90%, at least 91%, at least 92%, at least 93%, at least 94%, at least 95%, at least 96%, at least 97%, at least 98%, or at least 99% identical to the HC and LC of P1-068761_E32Y_E55A.IgG1.3, respectively;

(ww) a HC comprising the HC CDRs of the HC of P1-068761_E32Y_E56N.IgG1.3 and a LC comprising the LC CDRs of P1-068761_E32Y_E56N and HC and LC amino acid sequences that are at least 90%, at least 91%, at least 92%, at least 93%, at least 94%, at least 95%, at least 96%, at least 97%, at least 98%, or at least 99% identical to the HC and LC of P1-068761_E32Y_E56N.IgG1.3, respectively;

(xx) a HC comprising the HC CDRs of the HC of P1-068761_E30D_E32Y.IgG1.3 and a LC comprising the LC CDRs of P1-068761_E30D_E32Y and HC and LC amino acid sequences that are at least 90%, at least 91%, at least 92%, at least 93%, at least 94%, at least 95%, at least 96%, at least 97%, at least 98%, or at least 99% identical to the HC and LC of P1-068761_E30D_E32Y.IgG1.3, respectively;

(yy) a HC comprising the HC CDRs of the HC of P1-068761_E32Y_H100G.IgG1.3 and a LC comprising the LC CDRs of P1-068761_E32Y_H100G and HC and LC amino acid sequences that are at least 90%, at least 91%, at least 92%, at least 93%, at least 94%, at least 95%, at least 96%, at least 97%, at least 98%, or at least 99% identical to the HC and LC of P1-068761_E32Y_H100G.IgG1.3, respectively;

(zz) a HC comprising the HC CDRs of the HC of P1-068761_E32Y_E100fF.IgG1.3 and a LC comprising the LC CDRs of P1-068761_E32Y_E100fF and HC and LC amino acid sequences that are at least 90%, at least 91%, at least 92%, at least 93%, at least 94%, at least 95%, at least 96%, at least 97%, at least 98%, or at least 99% identical to the HC and LC of P1-068761_E32Y_E100fF.IgG1.3, respectively;

(aaa) a HC comprising the HC CDRs of the HC of P1-068767_D52N_D102V.IgG1.3 and a LC comprising the LC CDRs of P1-068767_D52N_D102V and HC and LC amino acid sequences that are at least 90%, at least 91%, at least 92%, at least 93%, at least 94%, at least 95%, at least 96%, at least 97%, at least 98%, or at least 99% identical to the HC and LC of P1-068767_D52N_D102V.IgG1.3, respectively;

(bbb) a HC comprising the HC CDRs of the HC of P1-068767_D52N.IgG1.3 and a LC comprising the LC CDRs of P1-068767_D52N and HC and LC amino acid sequences that are at least 90%, at least 91%, at least 92%, at least 93%, at least 94%, at least 95%, at least 96%, at least 97%, at least 98%, or at least 99% identical to the HC and LC of P1-068767_D52N.IgG1.3, respectively;

(ccc) a HC comprising the HC CDRs of the HC of P1-068767_D52N_E55A.IgG1.3 and a LC comprising the LC CDRs of P1-068767_D52N_E55A and HC and LC amino acid sequences that are at least 90%, at least 91%, at least 92%, at least 93%, at least 94%, at least 95%, at least 96%, at least 97%, at least 98%, or at least 99% identical to the HC and LC of P1-068767_D52N_E55A.IgG1.3, respectively;

(ddd) a HC comprising the HC CDRs of the HC of P1-068767_E55A_D102V.IgG1.3 and a LC comprising the LC CDRs of P1-068767_E55A_D102V and HC and LC amino acid sequences that are at least 90%, at least 91%, at least 92%, at least 93%, at least 94%, at least 95%, at least 96%, at least 97%, at least 98%, or at least 99% identical to the HC and LC of P1-068767_E55A_D102V.IgG1.3, respectively;

(eee) a HC comprising the HC CDRs of the HC of P1-068767_D102V.IgG1.3 and a LC comprising the LC CDRs of P1-068767_D102V and HC and LC amino acid sequences that are at least 90%, at least 91%, at least 92%, at least 93%, at least 94%, at least 95%, at least 96%, at least 97%, at least 98%, or at least 99% identical to the HC and LC of P1-068767_D102V.IgG1.3, respectively;

(fff) a HC comprising the HC CDRs of the HC of P1-068767_E55A.IgG1.3 and a LC comprising the LC CDRs of P1-068767_E55A and HC and LC amino acid sequences that are at least 90%, at least 91%, at least 92%, at least 93%, at least 94%, at least 95%, at least 96%, at least 97%, at least 98%, or at least 99% identical to the HC and LC of P1-068767_E55A.IgG1.3, respectively;

(ggg) a HC comprising the HC CDRs of the HC of P1-068767_E30D_D52N.IgG1.3 and a LC comprising the LC CDRs of P1-068767_E30D_D52N and HC and LC amino acid sequences that are at least 90%, at least 91%, at least 92%, at least 93%, at least 94%, at least 95%, at least 96%, at least 97%, at least 98%, or at least 99% identical to the HC and LC of P1-068767_E30D_D52N.IgG1.3, respectively;

(hhh) a HC comprising the HC CDRs of the HC of P1-068767_E30D_D102V.IgG1.3 and a LC comprising the LC CDRs of P1-068767_E30D_D102V and HC and LC amino acid sequences that are at least 90%, at least 91%, at least 92%, at least 93%, at least 94%, at least 95%, at least 96%, at least 97%, at least 98%, or at least 99% identical to the HC and LC of P1-068767_E30D_D102V.IgG1.3, respectively;

(iii) a HC comprising the HC CDRs of the HC of P1-068767_E30D.IgG1.3 and a LC comprising the LC CDRs of P1-068767_E30D and HC and LC amino acid sequences that are at least 90%, at least 91%, at least 92%, at least 93%, at least 94%, at least 95%, at least 96%, at least 97%, at least 98%, or at least 99% identical to the HC and LC of P1-068767_E30D.IgG1.3, respectively;

(jjj) a HC comprising the HC CDRs of the HC of P1-068767_E30D_E55A.IgG1.3 and a LC comprising the LC CDRs of P1-068767_E30D_E55A and HC and LC amino acid sequences that are at least 90%, at least 91%, at least 92%, at least 93%, at least 94%, at least 95%, at least 96%, at least 97%, at least 98%, or at least 99% identical to the HC and LC of P1-068767_E30D_E55A.IgG1.3, respectively;

(kkk) a HC comprising the HC CDRs of the HC of P1-068767_E100fF_D102V.IgG1.3 and a LC comprising the LC CDRs of P1-068767_E100fF_D102V and HC and LC amino acid sequences that are at least 90%, at least 91%, at least 92%, at least 93%, at least 94%, at least 95%, at least 96%, at least 97%, at least 98%, or at least 99% identical to the HC and LC of P1-068767_E100fF_D102V.IgG1.3, respectively;

(lll) a HC comprising the HC CDRs of the HC of P1-068767_E55A_E100fF.IgG1.3 and a LC comprising the LC CDRs of P1-068767_E55A_E100fF and HC and LC amino acid sequences that are at least 90%, at least 91%, at least 92%, at least 93%, at least 94%, at least 95%, at least 96%, at least 97%, at least 98%, or at least 99% identical to the HC and LC of P1-068767_E55A_E100fF.IgG1.3, respectively;

(mmm) a HC comprising the HC CDRs of the HC of P1-068767_D52N_E100fF.IgG1.3 and a LC comprising the LC CDRs of P1-068767_D52N_E100fF and HC and LC amino acid sequences that are at least 90%, at least 91%, at least 92%, at least 93%, at least 94%, at least 95%, at least 96%, at least 97%, at least 98%, or at least 99% identical to the HC and LC of P1-068767_D52N_E100fF.IgG1.3, respectively;

(nnn) a HC comprising the HC CDRs of the HC of P1-068767_E100fF.IgG1.3 and a LC comprising the LC CDRs of P1-068767_E100fF and HC and LC amino acid sequences that are at least 90%, at least 91%, at least 92%, at least 93%, at least 94%, at least 95%, at least 96%, at least 97%, at least 98%, or at least 99% identical to the HC and LC of P1-068767_E100fF.IgG1.3, respectively;

(ooo) a HC comprising the HC CDRs of the HC of P1-068767_E30D_E100fF.IgG1.3 and a LC comprising the LC CDRs of P1-068767_E30D_E100fF and HC and LC amino acid sequences that are at least 90%, at least 91%, at least 92%, at least 93%, at least 94%, at least 95%, at least 96%, at least 97%, at least 98%, or at least 99% identical to the HC and LC of P1-068767_E30D_E100fF.IgG1.3, respectively;

(ppp) a HC comprising the HC CDRs of the HC of P1-061029_F100fE_V102D.IgG1.3 and a LC comprising the LC CDRs of P1-061029_F100fE_V102D and HC and LC amino acid sequences that are at least 90%, at least 91%, at least 92%, at least 93%, at least 94%, at least 95%, at least 96%, at least 97%, at least 98%, or at least 99% identical to the HC and LC of P1-061029_F100fE_V102D.IgG1.3, respectively;

(qqq) a HC comprising the HC CDRs of the HC of P1-061029_F100fE.IgG1.3 and a LC comprising the LC CDRs of P1-061029_F10fE and HC and LC amino acid sequences that are at least 90%, at least 91%, at least 92%, at least 93%, at least 94%, at least 95%, at least 96%, at least 97%, at least 98%, or at least 99% identical to the HC and LC of P1-061029_F100fE.IgG1.3, respectively;

(rrr) a HC comprising the HC CDRs of the HC of P1-061029_V102D.IgG1.3 and a LC comprising the LC CDRs of P1-061029 V102D and HC and LC amino acid sequences that are at least 90%, at least 91%, at least 92%, at least 93%, at least 94%, at least 95%, at least 96%, at least 97%, at least 98%, or at least 99% identical to the HC and LC of P1-061029_V102D.IgG1.3, respectively;

(sss) a HC comprising the HC CDRs of the HC of P1-061029_Y32E.IgG1.3 and a LC comprising the LC CDRs of P1-061029_Y32E and HC and LC amino acid sequences that are at least 90%, at least 91%, at least 92%, at least 93%, at least 94%, at least 95%, at least 96%, at least 97%, at least 98%, or at least 99% identical to the HC and LC of P1-061029_Y32E.IgG1.3, respectively; or (ttt) a HC comprising the HC CDRs of the HC of P1-061029_Y32E_F100fE.IgG1.3 and a LC comprising the LC CDRs of P1-061029_Y32E_F100fE and HC and LC amino acid sequences that are at least 90%, at least 91%, at least 92%, at least 93%, at least 94%, at least 95%, at least 96%, at least 97%, at least 98%, or at least 99% identical to the HC and LC of P1-061029_Y32E_F100fE.IgG1.3, respectively.

In some of the above embodiments, the HC and/or LC may differ from the sequence of each of the species (a) to (ttt) by the presence of 1, 2, 3, 4, or 5 amino acid substitutions, such as 1, 2, 3, 4, or 5 conservative substitutions. In some embodiments, for example, the HC of P1-061029 or one of its progeny may comprise one or both of the K16R and T84A substitutions in the VH region of the HC (P1-061015 and its progeny already have an R and an A at those positions, respectively).

In some embodiments, an anti-hVISTA Ab may comprise:
(a) a heavy chain consisting of the amino acid sequence of the heavy chain of P1-061029.IgG1.3 and a light chain consisting of the amino acid sequence of the light chain of P1-061029;
(b) a heavy chain consisting of the amino acid sequence of the heavy chain of P1-061015.IgG1.3 and a light chain consisting of the amino acid sequence of the light chain of P1-061015;
(c) a heavy chain consisting of the amino acid sequence of the heavy chain of P1-068757.IgG1.3 and a light chain consisting of the amino acid sequence of the light chain of P1-068757;
(d) a heavy chain consisting of the amino acid sequence of the heavy chain of P1-068759.IgG1.3 and a light chain consisting of the amino acid sequence of the light chain of P1-068759;
(e) a heavy chain consisting of the amino acid sequence of the heavy chain of P1-068761.IgG1.3 and a light chain consisting of the amino acid sequence of the light chain of P1-068761;
(f) a heavy chain consisting of the amino acid sequence of the heavy chain of P1-068763.IgG1.3 and a light chain consisting of the amino acid sequence of the light chain of P1-068763;
(g) a heavy chain consisting of the amino acid sequence of the heavy chain of P1-068765.IgG1.3 and a light chain consisting of the amino acid sequence of the light chain of P1-068765;
(h) a heavy chain consisting of the amino acid sequence of the heavy chain of P1-068767.IgG1.3 and a light chain consisting of the amino acid sequence of the light chain of P1-068767;

(i) a heavy chain consisting of the amino acid sequence of the heavy chain of P1-068769.IgG1.3 and a light chain consisting of the amino acid sequence of the light chain of P1-068769;

(j) a heavy chain consisting of the amino acid sequence of the heavy chain of P1-068771.IgG1.3 and a light chain consisting of the amino acid sequence of the light chain of P1-068771;

(k) a heavy chain consisting of the amino acid sequence of the heavy chain of P1-068773.IgG1.3 and a light chain consisting of the amino acid sequence of the light chain of P1-068773;

(l) a heavy chain consisting of the amino acid sequence of the heavy chain of P1-068775.IgG1.3 and a light chain consisting of the amino acid sequence of the light chain of P1-068775;

(m) a heavy chain consisting of the amino acid sequence of the heavy chain of P1-069059.IgG1.3 and a light chain consisting of the amino acid sequence of the light chain of P1-069059;

(n) a heavy chain consisting of the amino acid sequence of the heavy chain of P1-069061.IgG1.3 and a light chain consisting of the amino acid sequence of the light chain of P1-069061;

(o) a heavy chain consisting of the amino acid sequence of the heavy chain of P1-069063.IgG1.3 and a light chain consisting of the amino acid sequence of the light chain of P1-069063;

(p) a heavy chain consisting of the amino acid sequence of the heavy chain of P1-069065.IgG1.3 and a light chain consisting of the amino acid sequence of the light chain of P1-069065;

(q) a heavy chain consisting of the amino acid sequence of the heavy chain of P1-069067.IgG1.3 and a light chain consisting of the amino acid sequence of the light chain of P1-069067;

(r) a heavy chain consisting of the amino acid sequence of the heavy chain of P1-069069.IgG1.3 and a light chain consisting of the amino acid sequence of the light chain of P1-069069;

(s) a heavy chain consisting of the amino acid sequence of the heavy chain of P1-069071.IgG1.3 and a light chain consisting of the amino acid sequence of the light chain of P1-069071;

(t) a heavy chain consisting of the amino acid sequence of the heavy chain of P1-069073.IgG1.3 and a light chain consisting of the amino acid sequence of the light chain of P1-069073;

(u) a heavy chain consisting of the amino acid sequence of the heavy chain of P1-069075.IgG1.3 and a light chain consisting of the amino acid sequence of the light chain of P1-069075;

(v) a heavy chain consisting of the amino acid sequence of the heavy chain of P1-069077.IgG1.3 and a light chain consisting of the amino acid sequence of the light chain of P1-069077;

(w) a heavy chain consisting of the amino acid sequence of the heavy chain of P1-068736 and a light chain consisting of the amino acid sequence of the light chain of P1-068736;

(x) a heavy chain consisting of the amino acid sequence of the heavy chain of P1-068738.IgG1.3 and a light chain consisting of the amino acid sequence of the light chain of P1-068738;

(y) a heavy chain consisting of the amino acid sequence of the heavy chain of P1-068740.IgG1.3 and a light chain consisting of the amino acid sequence of the light chain of P1-068740;

(z) a heavy chain consisting of the amino acid sequence of the heavy chain of P1-068742.IgG1.3 and a light chain consisting of the amino acid sequence of the light chain of P1-068742;

(aa) a heavy chain consisting of the amino acid sequence of the heavy chain of P1-068744.IgG1.3 and a light chain consisting of the amino acid sequence of the light chain of P1-068744;

(bb) a heavy chain consisting of the amino acid sequence of the heavy chain f P1-068746.IgG1.3 and a light chain consisting of the amino acid sequence of the light chain of P1-068746;

(cc) a heavy chain consisting of the amino acid sequence of the heavy chain of P1-068748.IgG1.3 and a light chain consisting of the amino acid sequence of the light chain of P1-068748;

(dd) a heavy chain consisting of the amino acid sequence of the heavy chain of P1-068750.IgG1.3 and a light chain consisting of the amino acid sequence of the light chain of P1-068750;

(ee) a heavy chain consisting of the amino acid sequence of the heavy chain of P1-068752.IgG1.3 and a light chain consisting of the amino acid sequence of the light chain of P1-068752;

(ff) a heavy chain consisting of the amino acid sequence of the heavy chain of P1-068754 and a light chain consisting of the amino acid sequence of the light chain of P1-068754;

(gg) a heavy chain consisting of the amino acid sequence of the heavy chain of P1-068761_E55A.IgG1.3 and a light chain consisting of the amino acid sequence of the light chain of P1-068761_E55A;

(hh) a heavy chain consisting of the amino acid sequence of the heavy chain of P1-068761_H100G.IgG1.3 and a light chain consisting of the amino acid sequence of the light chain of P1-068761_H100G;

(ii) a heavy chain consisting of the amino acid sequence of the heavy chain of P1-068761_E56N.IgG1.3 and a light chain consisting of the amino acid sequence of the light chain of P1-068761_E56N;

(jj) a heavy chain consisting of the amino acid sequence of the heavy chain of P1-068761_E55A_E56N.IgG1.3 and a light chain consisting of the amino acid sequence of the light chain of P1-068761_E55A_E56N;

(kk) a heavy chain consisting of the amino acid sequence of the heavy chain of P1-068761_E30D.IgG1.3 and a light chain consisting of the amino acid sequence of the light chain of P1-068761_E30D;

(ll) a heavy chain consisting of the amino acid sequence of the heavy chain of P1-068761_E30D_E55A.IgG1.3 and a light chain consisting of the amino acid sequence of the light chain of P1-068761_E30D_E55A;

(mm) a heavy chain consisting of the amino acid sequence of the heavy chain of P1-068761_E56N_H100G.IgG1.3 and a light chain consisting of the amino acid sequence of the light chain of P1-068761_E56N_H100G;

(nn) a heavy chain consisting of the amino acid sequence of the heavy chain of P1-068761_E30D_H100G.IgG1.3 and a light chain consisting of the amino acid sequence of the light chain of P1-068761_E30D_H100G;

(oo) a heavy chain consisting of the amino acid sequence of the heavy chain of P1-068761_E30D_E56N.IgG1.3 and a light chain consisting of the amino acid sequence of the light chain of P1-068761_E30D_E56N;

(pp) a heavy chain consisting of the amino acid sequence of the heavy chain of P1-068761_E100fF.IgG1.3 and a light chain consisting of the amino acid sequence of the light chain of P1-068761_E100fF;

(qq) a heavy chain consisting of the amino acid sequence of the heavy chain of P1-068761_E55A_E100fF.IgG1.3 and a light chain consisting of the amino acid sequence of the light chain of P1-068761_E55A_E100fF;

(rr) a heavy chain consisting of the amino acid sequence of the heavy chain of P1-068761_H100G_E100fF.IgG1.3 and a light chain consisting of the amino acid sequence of the light chain of P1-068761__H100G_E100fF;

(ss) a heavy chain consisting of the amino acid sequence of the heavy chain of P1-068761_E30D_E100fF.IgG1.3 and a light chain consisting of the amino acid sequence of the light chain of P1-068761_E30D_E100fF;

(tt) a heavy chain consisting of the amino acid sequence of the heavy chain of P1-068761_E56N_E100fF.IgG1.3 and a light chain consisting of the amino acid sequence of the light chain of P1-068761_E56N_E100fF;

(uu) a heavy chain consisting of the amino acid sequence of the heavy chain of P1-068761_E32Y.IgG1.3 and a light chain consisting of the amino acid sequence of the light chain of P1-068761_E32Y;

(vv) a heavy chain consisting of the amino acid sequence of the heavy chain of P1-068761_E32Y_E55A.IgG1.3 and a light chain consisting of the amino acid sequence of the light chain of P1-068761_E32Y_E55A;

(ww) a heavy chain consisting of the amino acid sequence of the heavy chain of P1-068761_E32Y_E56N.IgG1.3 and a light chain consisting of the amino acid sequence of the light chain of P1-068761_E32Y_E56N;

(xx) a heavy chain consisting of the amino acid sequence of the heavy chain of P1-068761_E30D_E32Y.IgG1.3 and a light chain consisting of the amino acid sequence of the light chain of P1-068761_E30D_E32Y;

(yy) a heavy chain consisting of the amino acid sequence of the heavy chain of P1-068761_E32Y_H100G.IgG1.3 and a light chain consisting of the amino acid sequence of the light chain of P1-068761_E32Y_H100G;

(zz) a heavy chain consisting of the amino acid sequence of the heavy chain of P1-068761_E32Y_E100fF.IgG1.3 and a light chain consisting of the amino acid sequence of the light chain of P1-068761_E32Y_E100fF;

(aaa) a heavy chain consisting of the amino acid sequence of the heavy chain of P1-068767_D52N_D102V.IgG1.3 and a light chain consisting of the amino acid sequence of the light chain of P1-068767_D52N_D102V;

(bbb) a heavy chain consisting of the amino acid sequence of the heavy chain of P1-068767_D52N.IgG1.3 and a light chain consisting of the amino acid sequence of the light chain of P1-068767_D52N;

(ccc) a heavy chain consisting of the amino acid sequence of the heavy chain of P1-068767_D52N_E55A.IgG1.3 and a light chain consisting of the amino acid sequence of the light chain of P1-068767_D52N_E55A;

(ddd) a heavy chain consisting of the amino acid sequence of the heavy chain of P1-068767_E55A_D102V.IgG1.3 and a light chain consisting of the amino acid sequence of the light chain of P1-068767_E55A_D102V;

(eee) a heavy chain consisting of the amino acid sequence of the heavy chain of P1-068767_D102V.IgG1.3 and a light chain consisting of the amino acid sequence of the light chain of P1-068767_D102V;

(fff) a heavy chain consisting of the amino acid sequence of the heavy chain of P1-068767_E55A.IgG1.3 and a light chain consisting of the amino acid sequence of the light chain of P1-068767_E55A;

(ggg) a heavy chain consisting of the amino acid sequence of the heavy chain of P1-068767_E30D_D52N.IgG1.3 and a light chain consisting of the amino acid sequence of the light chain of P1-068767_E30D_D52N;

(hhh) a heavy chain consisting of the amino acid sequence of the heavy chain of P1-068767_E30D_D102V.IgG1.3 and a light chain consisting of the amino acid sequence of the light chain of P1-068767_E30D_D102V;

(iii) a heavy chain consisting of the amino acid sequence of the heavy chain of P1-068767_E30D.IgG1.3 and a light chain consisting of the amino acid sequence of the light chain of P1-068767_E30D;

(jjj) a heavy chain consisting of the amino acid sequence of the heavy chain of P1-068767_E30D_E55A.IgG1.3 and a light chain consisting of the amino acid sequence of the light chain of P1-068767_E30D_E55A;

(kkk) a heavy chain consisting of the amino acid sequence of the heavy chain of P1-068767_E100fF_D102V.IgG1.3 and a light chain consisting of the amino acid sequence of the light chain of P1-068767_E100fF_D102V;

(lll) a heavy chain consisting of the amino acid sequence of the heavy chain of P1-068767_E55A_E100fF.IgG1.3 and a light chain consisting of the amino acid sequence of the light chain of P1-068767_E55A_E100fF;

(mmm) a heavy chain consisting of the amino acid sequence of the heavy chain of P1-068767_D52N_E100fF.IgG1.3 and a light chain consisting of the amino acid sequence of the light chain of P1-068767_D52N_E100fF;

(nnn) a heavy chain consisting of the amino acid sequence of the heavy chain of P1-068767_E100fF.IgG1.3 and a light chain consisting of the amino acid sequence of the light chain of P1-068767_E100fF;

(ooo) a heavy chain consisting of the amino acid sequence of the heavy chain of P1-068767_E30D_E100fF.IgG1.3 and a light chain consisting of the amino acid sequence of the light chain of P1-068767_E30D_E100fF;

(ppp) a heavy chain consisting of the amino acid sequence of the heavy chain of P1-061029_F100fE_V102D.IgG1.3 and a light chain consisting of the amino acid sequence of the light chain of P1-061029_F100fE_V102D;

(qqq) a heavy chain consisting of the amino acid sequence of the heavy chain of P1-061029_F100fE.IgG1.3 and a light chain consisting of the amino acid sequence of the light chain of P1-061029° F.10fE;

(rrr) a heavy chain consisting of the amino acid sequence of the heavy chain of P1-061029_V102D.IgG1.3 and a light chain consisting of the amino acid sequence of the light chain of P1-061029_V102D;

(sss) a heavy chain consisting of the amino acid sequence of the heavy chain of P1-061029_Y32E.IgG1.3 and a light chain consisting of the amino acid sequence of the light chain of P1-061029_Y32E; or (ttt) a heavy chain consisting of the amino acid sequence of the heavy chain of P1-061029_Y32E_F100fE.IgG1.3 and a light chain consisting of the amino acid sequence of the light chain of P1-061029_Y32E_F100fE, wherein, optionally wherein the VH in any of (a) to (ttt) comprises one or both of the K16R and T84A substitutions.

In some embodiments, the disclosure contemplates anti-VISTA mAbs comprising:

a heavy chain consisting of the amino acid sequences of the heavy chain of (a) to (ttt) listed above followed by a Lys residue; and a light chain consisting of the light chain amino acid sequence of (a) to (ttt) listed above;

wherein the heavy chain and light chain amino acid sequences are chosen from the same antibody species from among (a) to (ttt) listed above.

In some embodiments, an anti-hVISTA Ab may comprise a heavy chain amino acid sequence comprising the VH amino acid sequence of the antibody species herein, but rather than an IgG1.3 heavy chain constant region, as provided in the HC sequences in the Sequence Table herein (and see SEQ ID NO: 163), the antibody may comprise a different heavy chain constant region sequence, such as a human wild-type IgG1 constant region such as human IgG1 allotype f (IgG1f) (SEQ ID NO: 182), or a modified human IgG1 constant region such as IgG1.1f (SEQ ID NO: 183), or a modified human IgG1 constant region such as IgG1.P238K (SEQ ID NO: 184). Accordingly, embodiments of this disclosure include anti-VISTA Abs comprising:

(a) a heavy chain comprising (i) the amino acid sequence of the VH of P1-061029 (SEQ ID NO: 67) and (ii) the amino acid sequence of SEQ ID NO: 182, and a light chain comprising the light chain amino acid sequence of P1-061029 (SEQ ID NO: 70);

(b) a heavy chain comprising (i) the amino acid sequence of the VH of P1-061015 and (ii) the amino acid sequence of SEQ ID NO: 182, and a light chain comprising the light chain amino acid sequence of P1-061015;

(c) a heavy chain comprising (i) the amino acid sequence of the VH of P1-068757 and (ii) the amino acid sequence of SEQ ID NO: 182, and a light chain comprising the light chain amino acid sequence of P1-068757;

(d) a heavy chain comprising (i) the amino acid sequence of the VH of P1-068759 and (ii) the amino acid sequence of SEQ ID NO: 182, and a light chain comprising the light chain amino acid sequence of P1-068759;

(e) a heavy chain comprising (i) the amino acid sequence of the VH of P1-068761 and (ii) the amino acid sequence of SEQ ID NO: 182, and a light chain comprising the light chain amino acid sequence of P1-068761;

(f) a heavy chain comprising (i) the amino acid sequence of the VH of P1-068763 and (ii) the amino acid sequence of SEQ ID NO: 182, and a light chain comprising the light chain amino acid sequence of P1-068763;

(g) a heavy chain comprising (i) the amino acid sequence of the VH of P1-068765 and (ii) the amino acid sequence of SEQ ID NO: 182, and a light chain comprising the light chain amino acid sequence of P1-068765;

(h) a heavy chain comprising (i) the amino acid sequence of the VH of P1-068767 and (ii) the amino acid sequence of SEQ ID NO: 182, and a light chain comprising the light chain amino acid sequence of P1-068767;

(i) a heavy chain comprising (i) the amino acid sequence of the VH of P1-068769 and (ii) the amino acid sequence of SEQ ID NO: 182, and a light chain comprising the light chain amino acid sequence of P1-068769;

(j) a heavy chain comprising (i) the amino acid sequence of the VH of P1-068771 and (ii) the amino acid sequence of SEQ ID NO: 182, and a light chain comprising the light chain amino acid sequence of P1-068771;

(k) a heavy chain comprising (i) the amino acid sequence of the VH of P1-068773 and (ii) the amino acid sequence of SEQ ID NO: 182, and a light chain comprising the light chain amino acid sequence of P1-068773;

(l) a heavy chain comprising (i) the amino acid sequence of the VH of P1-068775 and (ii) the amino acid sequence of SEQ ID NO: 182, and a light chain comprising the light chain amino acid sequence of P1-068775;

(m) a heavy chain comprising (i) the amino acid sequence of the VH of P1-069059 and (ii) the amino acid sequence of SEQ ID NO: 182, and a light chain comprising the light chain amino acid sequence of P1-069059;

(n) a heavy chain comprising (i) the amino acid sequence of the VH of P1-069061 and (ii) the amino acid sequence of SEQ ID NO: 182, and a light chain comprising the light chain amino acid sequence of P1-069061;

(o) a heavy chain comprising (i) the amino acid sequence of the VH of P1-069063 and (ii) the amino acid sequence of SEQ ID NO: 182, and a light chain comprising the light chain amino acid sequence of P1-069063;

(p) a heavy chain comprising (i) the amino acid sequence of the VH of P1-069065 and (ii) the amino acid sequence of SEQ ID NO: 182, and a light chain comprising the light chain amino acid sequence of P1-069065;

(q) a heavy chain comprising (i) the amino acid sequence of the VH of P1-069067 and (ii) the amino acid sequence of SEQ ID NO: 182, and a light chain comprising the light chain amino acid sequence of P1-069067;

(r) a heavy chain comprising (i) the amino acid sequence of the VH of P1-069069 and (ii) the amino acid sequence of SEQ ID NO: 182, and a light chain comprising the light chain amino acid sequence of P1-069069;

(s) a heavy chain comprising (i) the amino acid sequence of the VH of P1-069071 and (ii) the amino acid sequence of SEQ ID NO: 182, and a light chain comprising the light chain amino acid sequence of P1-069071;

(t) a heavy chain comprising (i) the amino acid sequence of the VH of P1-069073 and (ii) the amino acid sequence of SEQ ID NO: 182, and a light chain comprising the light chain amino acid sequence of P1-069073;
(u) a heavy chain comprising (i) the amino acid sequence of the VH of P1-069075 and (ii) the amino acid sequence of SEQ ID NO: 182, and a light chain comprising the light chain amino acid sequence of P1-069075;
(v) a heavy chain comprising (i) the amino acid sequence of the VH of P1-069077 and (ii) the amino acid sequence of SEQ ID NO: 182, and a light chain comprising the light chain amino acid sequence of P1-069077;
(w) a heavy chain comprising (i) the amino acid sequence of the VH of P1-068736 and (ii) the amino acid sequence of SEQ ID NO: 182, and a light chain comprising the light chain amino acid sequence of P1-068736;
(x) a heavy chain comprising (i) the amino acid sequence of the VH of P1-068738 and (ii) the amino acid sequence of SEQ ID NO: 182, and a light chain comprising the light chain amino acid sequence of P1-068738;
(y) a heavy chain comprising (i) the amino acid sequence of the VH of P1-068740 and (ii) the amino acid sequence of SEQ ID NO: 182, and a light chain comprising the light chain amino acid sequence of P1-068740;
(z) a heavy chain comprising (i) the amino acid sequence of the VH of P1-068742 and (ii) the amino acid sequence of SEQ ID NO: 182, and a light chain comprising the light chain amino acid sequence of P1-068742;
(aa) a heavy chain comprising (i) the amino acid sequence of the VH of P1-068744 and (ii) the amino acid sequence of SEQ ID NO: 182, and a light chain comprising the light chain amino acid sequence of P1-068744;
(bb) a heavy chain comprising the amino acid sequence of the VH of P1-068746 and (ii) the amino acid sequence of SEQ ID NO: 182, and a light chain comprising the light chain amino acid sequence of P1-068746;
(cc) a heavy chain comprising (i) the amino acid sequence of the VH of P1-068748 and (ii) the amino acid sequence of SEQ ID NO: 182, and a light chain comprising the light chain amino acid sequence of P1-068748;
(dd) a heavy chain comprising (i) the amino acid sequence of the VH of P1-068750 and (ii) the amino acid sequence of SEQ ID NO: 182, and a light chain comprising the light chain amino acid sequence of P1-068750;
(ee) a heavy chain comprising (i) the amino acid sequence of the VH of P1-068752 and (ii) the amino acid sequence of SEQ ID NO: 182, and a light chain comprising the light chain amino acid sequence of P1-068752;
(f) a heavy chain comprising (i) the amino acid sequence of the VH of P1-068754 and (ii) the amino acid sequence of SEQ ID NO: 182, and a light chain comprising the light chain amino acid sequence of P1-068754;
(gg) a heavy chain comprising (i) the amino acid sequence of the VH of P1-068761_E55A and (ii) the amino acid sequence of SEQ ID NO: 182, and a light chain comprising the light chain amino acid sequence of P1-068761_E55A;
(hh) a heavy chain comprising (i) the amino acid sequence of the VH of P1-068761_H100G and (ii) the amino acid sequence of SEQ ID NO: 182, and a light chain comprising the light chain amino acid sequence of P1-068761_H100G;
(ii) a heavy chain comprising (i) the amino acid sequence of the VH of P1-068761_E56N and (ii) the amino acid sequence of SEQ ID NO: 182, and a light chain comprising the light chain amino acid sequence of P1-068761_E56N;
(jj) a heavy chain comprising (i) the amino acid sequence of the VH of P1-068761_E55A_E56N and (ii) the amino acid sequence of SEQ ID NO: 182, and a light chain comprising the light chain amino acid sequence of P1-068761_E55A_E56N;
(kk) a heavy chain comprising (i) the amino acid sequence of the VH of P1-068761_E30D and (ii) the amino acid sequence of SEQ ID NO: 182, and a light chain comprising the light chain amino acid sequence of P1-068761_E30D;
(ll) a heavy chain comprising (i) the amino acid sequence of the VH of P1-068761_E30D_E55A and (ii) the amino acid sequence of SEQ ID NO: 182, and a light chain comprising the light chain amino acid sequence of P1-068761_E30D_E55A;
(mm) a heavy chain comprising (i) the amino acid sequence of the VH of P1-068761_E56N_H100G and (ii) the amino acid sequence of SEQ ID NO: 182, and a light chain comprising the light chain amino acid sequence of P1-068761_E56N_H100G;
(nn) a heavy chain comprising (i) the amino acid sequence of the VH of P1-068761_E30D_H100G and (ii) the amino acid sequence of SEQ ID NO: 182, and a light chain comprising the light chain amino acid sequence of P1-068761_E30D_H100G;
(oo) a heavy chain comprising (i) the amino acid sequence of the VH of P1-068761_E30D_E56N and (ii) the amino acid sequence of SEQ ID NO: 182, and a light chain comprising the light chain amino acid sequence of P1-068761_E30D_E56N;
(pp) a heavy chain comprising (i) the amino acid sequence of the VH of P1-068761_E100fF and (ii) the amino acid sequence of SEQ ID NO: 182, and a light chain comprising the light chain amino acid sequence of P1-068761_E100fF;
(qq) a heavy chain comprising (i) the amino acid sequence of the VH of P1-068761_E55A_E100fF and (ii) the amino acid sequence of SEQ ID NO: 182, and a light chain comprising the light chain amino acid sequence of P1-068761_E55A_E100fF;
(rr) a heavy chain comprising (i) the amino acid sequence of the VH of P1-068761_H100G_E100fF and (ii) the amino acid sequence of SEQ ID NO: 182, and a light chain comprising the light chain amino acid sequence of P1-068761_H100G_E100fF;
(ss) a heavy chain comprising (i) the amino acid sequence of the VH of P1-068761_E30D_E100fF and (ii) the amino acid sequence of SEQ ID NO: 182, and a light chain comprising the light chain amino acid sequence of P1-068761_E30D_E100fF;
(tt) a heavy chain comprising (i) the amino acid sequence of the VH of P1-068761_E56N_E100fF and (ii) the amino acid sequence of SEQ ID NO: 182, and a light chain comprising the light chain amino acid sequence of P1-068761_E56N_E100fF;
(uu) a heavy chain comprising (i) the amino acid sequence of the VH of P1-068761_E32Y and (ii) the amino acid sequence of SEQ ID NO: 182, and a light chain comprising the light chain amino acid sequence of P1-068761_E32Y;

(vv) a heavy chain comprising (i) the amino acid sequence of the VH of P1-068761_E32Y_E55A and (ii) the amino acid sequence of SEQ ID NO: 182, and a light chain comprising the light chain amino acid sequence of P1-068761_E32Y_E55A;

(ww) a heavy chain comprising (i) the amino acid sequence of the VH of P1-068761_E32Y_E56N and (ii) the amino acid sequence of SEQ ID NO: 182, and a light chain comprising the light chain amino acid sequence of P1-068761_E32Y_E56N;

(xx) a heavy chain comprising (i) the amino acid sequence of the VH of P1-068761_E30D_E32Y and (ii) the amino acid sequence of SEQ ID NO: 182, and a light chain comprising the light chain amino acid sequence of P1-068761_E30D_E32Y;

(yy) a heavy chain comprising (i) the amino acid sequence of the VH of P1-068761_E32Y_H100G and (ii) the amino acid sequence of SEQ ID NO: 182, and a light chain comprising the light chain amino acid sequence of P1-068761_E32Y_H100G;

(zz) a heavy chain comprising (i) the amino acid sequence of the VH of P1-068761_E32Y_E100fF and (ii) the amino acid sequence of SEQ ID NO: 182, and a light chain comprising the light chain amino acid sequence of P1-068761_E32Y_E100fF;

(aaa) a heavy chain comprising (i) the amino acid sequence of the VH of P1-068767_D52N_D102V and (ii) the amino acid sequence of SEQ ID NO: 182, and a light chain comprising the light chain amino acid sequence of P1-068767_D52N_D102V;

(bbb) a heavy chain comprising (i) the amino acid sequence of the VH of P1-068767_D52N and (ii) the amino acid sequence of SEQ ID NO: 182, and a light chain comprising the light chain amino acid sequence of P1-068767_D52N;

(ccc) a heavy chain comprising (i) the amino acid sequence of the VH of P1-068767_D52N_E55A and (ii) the amino acid sequence of SEQ ID NO: 182, and a light chain comprising the light chain amino acid sequence of P1-068767_D52N_E55A;

(ddd) a heavy chain comprising (i) the amino acid sequence of the VH of P1-068767_E55A_D102V and (ii) the amino acid sequence of SEQ ID NO: 182, and a light chain comprising the light chain amino acid sequence of P1-068767_E55A_D102V;

(eee) a heavy chain comprising (i) the amino acid sequence of the VH of P1-068767_D102V and (ii) the amino acid sequence of SEQ ID NO: 182, and a light chain comprising the light chain amino acid sequence of P1-068767_D102V;

(fff) a heavy chain comprising (i) the amino acid sequence of the VH of P1-068767_E55A and (ii) the amino acid sequence of SEQ ID NO: 182, and a light chain comprising the light chain amino acid sequence of P1-068767-E55A;

(ggg) a heavy chain comprising (i) the amino acid sequence of the VH of P1-068767_E30D_D52N and (ii) the amino acid sequence of SEQ ID NO: 182, and a light chain comprising the light chain amino acid sequence of P1-068767_E30D_D52N;

(hhh) a heavy chain comprising (i) the amino acid sequence of the VH of P1-068767_E30D_D102V and (ii) the amino acid sequence of SEQ ID NO: 182, and a light chain comprising the light chain amino acid sequence of P1-068767_E30D_D102V;

(iii) a heavy chain comprising (i) the amino acid sequence of the VH of P1-068767_E30D and (ii) the amino acid sequence of SEQ ID NO: 182, and a light chain comprising the light chain amino acid sequence of P1-068767_E30D;

(jjj) a heavy chain comprising (i) the amino acid sequence of the VH of P1-068767_E30D_E55A and (ii) the amino acid sequence of SEQ ID NO: 182, and a light chain comprising the light chain amino acid sequence of P1-068767_E30D_E55A;

(kkk) a heavy chain comprising (i) the amino acid sequence of the VH of P1-068767_E100fF_D102V and (ii) the amino acid sequence of SEQ ID NO: 182, and a light chain comprising the light chain amino acid sequence of P1-068767_E100fF_D102V;

(lll) a heavy chain comprising (i) the amino acid sequence of the VH of P1-068767_E55A_E100fF and (ii) the amino acid sequence of SEQ ID NO: 182, and a light chain comprising the light chain amino acid sequence of P1-068767 E55A_E100fF;

(mmm) a heavy chain comprising (i) the amino acid sequence of the VH of P1-068767_D52N_E100fF and (ii) the amino acid sequence of SEQ ID NO: 182, and a light chain comprising the light chain amino acid sequence of P1-068767_D52N_E100fF;

(nnn) a heavy chain comprising (i) the amino acid sequence of the VH of P1-068767_E100fF and (ii) the amino acid sequence of SEQ ID NO: 182, and a light chain comprising the light chain amino acid sequence of P1-068767_E100fF;

(ooo) a heavy chain comprising (i) the amino acid sequence of the VH of P1-068767_E30D_E100fF and (ii) the amino acid sequence of SEQ ID NO: 182, and a light chain comprising the light chain amino acid sequence of P1-068767_E30D_E100fF;

(ppp) a heavy chain comprising (i) the amino acid sequence of the VH of P1-061029_F100fE_V102D and (ii) the amino acid sequence of SEQ ID NO: 182, and a light chain comprising the light chain amino acid sequence of P1-061029_F100fE_V102D;

(qqq) a heavy chain comprising (i) the amino acid sequence of the VH of P1-061029_F100fE and (ii) the amino acid sequence of SEQ ID NO: 182, and a light chain comprising the light chain amino acid sequence of P1-061029_F100fE;

(rrr) a heavy chain comprising (i) the amino acid sequence of the VH of P1-061029_V102D and (ii) the amino acid sequence of SEQ ID NO: 182, and a light chain comprising the light chain amino acid sequence of P1-061029_V102D;

(sss) a heavy chain comprising (i) the amino acid sequence of the VH of P1-061029_Y32E and (ii) the amino acid sequence of SEQ ID NO: 182, and a light chain comprising the light chain amino acid sequence of P1-061029_Y32E; or (ttt) a heavy chain comprising (i) the amino acid sequence of the VH of P1-061029_Y32E_F100fE and (ii) the amino acid sequence of SEQ ID NO: 182, and a light chain comprising the light chain amino acid sequence of P1-061029_Y32E_F100fE, optionally wherein the VH in any of (a) to (ttt) comprises one or both of the K16R and T84A substitutions.

In some embodiments, the LC may be as specified in (a) to (ttt) above, but the HC may differ from the sequence of each of the species (a) to ttt) by the presence of 1, 2, 3, 4, or 5 amino acid substitutions, such as 1, 2, 3, 4, or 5 conservative substitutions. In some embodiments, for example, the HC of P1-061029 or one of its progeny may comprise one or both of the K16R and T84A substitutions in the VH region of the HC (P1-061015 and its progeny already have an R at VH position 16 and an A at VH position 84).

Certain embodiments of this disclosure include anti-VISTA Abs comprising:

(a) a heavy chain consisting of (i) the amino acid sequence of the VH of P1-061029 (SEQ ID NO: 67) and (ii) the amino acid sequence of SEQ ID NO: 182, and a light chain consisting of the light chain amino acid sequence of P1-061029 (SEQ ID NO: 70);

(b) a heavy chain consisting of (i) the amino acid sequence of the VH of P1-061015 and (ii) the amino acid sequence of SEQ ID NO: 182, and a light chain consisting of the light chain amino acid sequence of P1-061015;

(c) a heavy chain consisting of (i) the amino acid sequence of the VH of P1-068757 and (ii) the amino acid sequence of SEQ ID NO: 182, and a light chain consisting of the light chain amino acid sequence of P1-068757;

(d) a heavy chain consisting of (i) the amino acid sequence of the VH of P1-068759 and (ii) the amino acid sequence of SEQ ID NO: 182, and a light chain consisting of the light chain amino acid sequence of P1-068759;

(e) a heavy chain consisting of (i) the amino acid sequence of the VH of P1-068761 and (ii) the amino acid sequence of SEQ ID NO: 182, and a light chain consisting of the light chain amino acid sequence of P1-068761;

(f) a heavy chain consisting of (i) the amino acid sequence of the VH of P1-068763 and (ii) the amino acid sequence of SEQ ID NO: 182, and a light chain consisting of the light chain amino acid sequence of P1-068763;

(g) a heavy chain consisting of (i) the amino acid sequence of the VH of P1-068765 and (ii) the amino acid sequence of SEQ ID NO: 182, and a light chain consisting of the light chain amino acid sequence of P1-068765;

(h) a heavy chain consisting of (i) the amino acid sequence of the VH of P1-068767 and (ii) the amino acid sequence of SEQ ID NO: 182, and a light chain consisting of the light chain amino acid sequence of P1-068767;

(i) a heavy chain consisting of (i) the amino acid sequence of the VH of P1-068769 and (ii) the amino acid sequence of SEQ ID NO: 182, and a light chain consisting of the light chain amino acid sequence of P1-068769;

(j) a heavy chain consisting of (i) the amino acid sequence of the VH of P1-068771 and (ii) the amino acid sequence of SEQ ID NO: 182, and a light chain consisting of the light chain amino acid sequence of P1-068771;

(k) a heavy chain consisting of (i) the amino acid sequence of the VH of P1-068773 and (ii) the amino acid sequence of SEQ ID NO: 182, and a light chain consisting of the light chain amino acid sequence of P1-068773;

(l) a heavy chain consisting of (i) the amino acid sequence of the VH of P1-068775 and (ii) the amino acid sequence of SEQ ID NO: 182, and a light chain consisting of the light chain amino acid sequence of P1-068775;

(m) a heavy chain consisting of (i) the amino acid sequence of the VH of P1-069059 and (ii) the amino acid sequence of SEQ ID NO: 182, and a light chain consisting of the light chain amino acid sequence of P1-069059;

(n) a heavy chain consisting of (i) the amino acid sequence of the VH of P1-069061 and (ii) the amino acid sequence of SEQ ID NO: 182, and a light chain consisting of the light chain amino acid sequence of P1-069061;

(o) a heavy chain consisting of (i) the amino acid sequence of the VH of P1-069063 and (ii) the amino acid sequence of SEQ ID NO: 182, and a light chain consisting of the light chain amino acid sequence of P1-069063;

(p) a heavy chain consisting of (i) the amino acid sequence of the VH of P1-069065 and (ii) the amino acid sequence of SEQ ID NO: 182, and a light chain consisting of the light chain amino acid sequence of P1-069065;

(q) a heavy chain consisting of (i) the amino acid sequence of the VH of P1-069067 and (ii) the amino acid sequence of SEQ ID NO: 182, and a light chain consisting of the light chain amino acid sequence of P1-069067;

(r) a heavy chain consisting of (i) the amino acid sequence of the VH of P1-069069 and (ii) the amino acid sequence of SEQ ID NO: 182, and a light chain consisting of the light chain amino acid sequence of P1-069069;

(s) a heavy chain consisting of (i) the amino acid sequence of the VH of P1-069071 and (ii) the amino acid sequence of SEQ ID NO: 182, and a light chain consisting of the light chain amino acid sequence of P1-069071;

(t) a heavy chain consisting of (i) the amino acid sequence of the VH of P1-069073 and (ii) the amino acid sequence of SEQ ID NO: 182, and a light chain consisting of the light chain amino acid sequence of P1-069073;

(u) a heavy chain consisting of (i) the amino acid sequence of the VH of P1-069075 and (ii) the amino acid sequence of SEQ ID NO: 182, and a light chain consisting of the light chain amino acid sequence of P1-069075;

(v) a heavy chain consisting of (i) the amino acid sequence of the VH of P1-069077 and (ii) the amino acid sequence of SEQ ID NO: 182, and a light chain consisting of the light chain amino acid sequence of P1-069077;

(w) a heavy chain consisting of (i) the amino acid sequence of the VH of P1-068736 and (ii) the amino acid sequence of SEQ ID NO: 182, and a light chain consisting of the light chain amino acid sequence of P1-068736;

(x) a heavy chain consisting of (i) the amino acid sequence of the VH of P1-068738 and (ii) the amino acid sequence of SEQ ID NO: 182, and a light chain consisting of the light chain amino acid sequence of P1-068738;

(y) a heavy chain consisting of (i) the amino acid sequence of the VH of P1-068740 and (ii) the amino acid sequence of SEQ ID NO: 182, and a light chain consisting of the light chain amino acid sequence of P1-068740;

(z) a heavy chain consisting of (i) the amino acid sequence of the VH of P1-068742 and (ii) the amino acid sequence of SEQ ID NO: 182, and a light chain consisting of the light chain amino acid sequence of P1-068742;

(aa) a heavy chain consisting of (i) the amino acid sequence of the VH of P1-068744 and (ii) the amino acid sequence of SEQ ID NO: 182, and a light chain consisting of the light chain amino acid sequence of P1-068744;

(bb) a heavy chain consisting of the amino acid sequence of the VH of P1-068746 and (ii) the amino acid sequence of SEQ ID NO: 182, and a light chain consisting of the light chain amino acid sequence of P1-068746;

(cc) a heavy chain consisting of (i) the amino acid sequence of the VH of P1-068748 and (ii) the amino acid sequence of SEQ ID NO: 182, and a light chain consisting of the light chain amino acid sequence of P1-068748;

(dd) a heavy chain consisting of (i) the amino acid sequence of the VII of P1-068750 and (ii) the amino acid sequence of SEQ ID NO: 182, and a light chain consisting of the light chain amino acid sequence of P1-068750;

(ee) a heavy chain consisting of (i) the amino acid sequence of the VH of P1-068752 and (ii) the amino acid sequence of SEQ ID NO: 182, and a light chain consisting of the light chain amino acid sequence of P1-068752;

(ff) a heavy chain consisting of (i) the amino acid sequence of the VH of P1-068754 and (ii) the amino acid sequence of SEQ ID NO: 182, and a light chain consisting of the light chain amino acid sequence of P1-068754;

(gg) a heavy chain consisting of (i) the amino acid sequence of the VH of P1-068761_E55A and (ii) the amino acid sequence of SEQ ID NO: 182, and a light chain consisting of the light chain amino acid sequence of P1-068761_E55A;

(hh) a heavy chain consisting of (i) the amino acid sequence of the VH of P1-068761_H100G and (ii) the amino acid sequence of SEQ ID NO: 182, and a light chain consisting of the light chain amino acid sequence of P1-068761_H100G;

(ii) a heavy chain consisting of (i) the amino acid sequence of the VH of P1-068761_E56N and (ii) the amino acid sequence of SEQ ID NO: 182, and a light chain consisting of the light chain amino acid sequence of P1-068761_E56N;

(jj) a heavy chain consisting of (i) the amino acid sequence of the VH of P1-068761_E55A_E56N and (ii) the amino acid sequence of SEQ ID NO: 182, and a light chain consisting of the light chain amino acid sequence of P1-068761_E55A_E56N;

(kk) a heavy chain consisting of (i) the amino acid sequence of the VH of P1-068761_E30D and (ii) the amino acid sequence of SEQ ID NO: 182, and a light chain consisting of the light chain amino acid sequence of P1-068761_E30D;

(ll) a heavy chain consisting of (i) the amino acid sequence of the VH of P1-068761_E30D_E55A and (ii) the amino acid sequence of SEQ ID NO: 182, and a light chain consisting of the light chain amino acid sequence of P1-068761_E30D_E55A;

(mm) a heavy chain consisting of (i) the amino acid sequence of the VH of P1-068761_E56N_H100G and (ii) the amino acid sequence of SEQ ID NO: 182, and a light chain consisting of the light chain amino acid sequence of P1-068761_E56N_H100G;

(nn) a heavy chain consisting of (i) the amino acid sequence of the VH of P1-068761_E30D_H100G and (ii) the amino acid sequence of SEQ ID NO: 182, and a light chain consisting of the light chain amino acid sequence of P1-068761_E30D_H100G;

(oo) a heavy chain consisting of (i) the amino acid sequence of the VH of P1-068761_E30D_E56N and (ii) the amino acid sequence of SEQ ID NO: 182, and a light chain consisting of the light chain amino acid sequence of P1-068761_E30D_E56N;

(pp) a heavy chain consisting of (i) the amino acid sequence of the VH of P1-068761_E100fF and (ii) the amino acid sequence of SEQ ID NO: 182, and a light chain consisting of the light chain amino acid sequence of P1-068761_E100fF;

(qq) a heavy chain consisting of (i) the amino acid sequence of the VH of P1-068761_E55A_E100fF and (ii) the amino acid sequence of SEQ ID NO: 182, and a light chain consisting of the light chain amino acid sequence of P1-068761_E55A_E100fF;

(rr) a heavy chain consisting of (i) the amino acid sequence of the VH of P1-068761_H100G_E100fF and (ii) the amino acid sequence of SEQ ID NO: 182, and a light chain consisting of the light chain amino acid sequence of P1-068761_H100G_E100fF;

(ss) a heavy chain consisting of (i) the amino acid sequence of the VH of P1-068761_E30D_E100fF and (ii) the amino acid sequence of SEQ ID NO: 182, and a light chain consisting of the light chain amino acid sequence of P1-068761_E30D_E100fF;

(tt) a heavy chain consisting of (i) the amino acid sequence of the VH of P1-068761_E56N_E100fF and (ii) the amino acid sequence of SEQ ID NO: 182, and a light chain consisting of the light chain amino acid sequence of P1-068761_E56N_E100fF;

(uu) a heavy chain consisting of (i) the amino acid sequence of the VH of P1-068761_E32Y and (ii) the amino acid sequence of SEQ ID NO: 182, and a light chain consisting of the light chain amino acid sequence of P1-068761_E32Y;

(vv) a heavy chain consisting of (i) the amino acid sequence of the VH of P1-068761_E32Y_E55A and (ii) the amino acid sequence of SEQ ID NO: 182, and a light chain consisting of the light chain amino acid sequence of P1-068761_E32Y_E55A;

(ww) a heavy chain consisting of (i) the amino acid sequence of the VH of P1-068761_E32Y_E56N and (ii) the amino acid sequence of SEQ ID NO: 182, and a light chain consisting of the light chain amino acid sequence of P1-068761_E32Y_E56N;

(xx) a heavy chain consisting of (i) the amino acid sequence of the VH of P1-068761_E30D_E32Y and (ii) the amino acid sequence of SEQ ID NO: 182, and a light chain consisting of the light chain amino acid sequence of P1-068761_E30D_E32Y;

(yy) a heavy chain consisting of (i) the amino acid sequence of the VH of P1-068761_E32Y_H100G and (ii) the amino acid sequence of SEQ ID NO: 182, and a light chain consisting of the light chain amino acid sequence of P1-068761_E32Y_H100G;

(zz) a heavy chain consisting of (i) the amino acid sequence of the VH of P1-068761_E32Y_E100fF and (ii) the amino acid sequence of SEQ ID NO: 182, and a light chain consisting of the light chain amino acid sequence of P1-068761_E32Y_E100fF;

(aaa) a heavy chain consisting of (i) the amino acid sequence of the VH of P1-068767_D52N_D102V and (ii) the amino acid sequence of SEQ ID NO: 182, and a light chain consisting of the light chain amino acid sequence of P1-068767_D52N_D102V;

(bbb) a heavy chain consisting of (i) the amino acid sequence of the VH of P1-068767_D52N and (ii) the amino acid sequence of SEQ ID NO: 182, and a light chain consisting of the light chain amino acid sequence of P1-068767_D52N;

(ccc) a heavy chain consisting of (i) the amino acid sequence of the VH of P1-068767_D52N_E55A and (ii) the amino acid sequence of SEQ ID NO: 182, and a light chain consisting of the light chain amino acid sequence of P1-068767_D52N_E55A;

(ddd) a heavy chain consisting of (i) the amino acid sequence of the VH of P1-068767_E55A_D102V and (ii) the amino acid sequence of SEQ ID NO: 182, and a light chain consisting of the light chain amino acid sequence of P1-068767_E55A_D102V;

(eee) a heavy chain consisting of (i) the amino acid sequence of the VH of P1-068767_D102V and (ii) the amino acid sequence of SEQ ID NO: 182, and a light chain consisting of the light chain amino acid sequence of P1-068767_D102V;

(fff) a heavy chain consisting of (i) the amino acid sequence of the VH of P1-068767_E55A and (ii) the amino acid sequence of SEQ ID NO: 182, and a light chain consisting of the light chain amino acid sequence of P1-068767_E55A;

(ggg) a heavy chain consisting of (i) the amino acid sequence of the VH of P1-068767_E30D_D52N and (ii) the amino acid sequence of SEQ ID NO: 182, and a light chain consisting of the light chain amino acid sequence of P1-068767_E30D_D52N;

(hhh) a heavy chain consisting of (i) the amino acid sequence of the VH of P1-068767_E30D_D102V and (ii) the amino acid sequence of SEQ ID NO: 182, and a light chain consisting of the light chain amino acid sequence of P1-068767_E30D_D102V;

(iii) a heavy chain consisting of (i) the amino acid sequence of the VH of P1-068767_E30D and (ii) the amino acid sequence of SEQ ID NO: 182, and a light chain consisting of the light chain amino acid sequence of P1-068767_E30D;

(jjj) a heavy chain consisting of (i) the amino acid sequence of the VH of P1-068767_E30D_E55A and (ii) the amino acid sequence of SEQ ID NO: 182, and a light chain consisting of the light chain amino acid sequence of P1-068767_E30D_E55A;

(kkk) a heavy chain consisting of (i) the amino acid sequence of the VH of P1-068767_E100fF_D102V and (ii) the amino acid sequence of SEQ ID NO: 182, and a light chain consisting of the light chain amino acid sequence of P1-068767_E100fF_D102V;

(lll) a heavy chain consisting of (i) the amino acid sequence of the VH of P1-068767_E55A_E100fF and (ii) the amino acid sequence of SEQ ID NO: 182, and a light chain consisting of the light chain amino acid sequence of P1-068767_E55A_E100fF;

(mmm) a heavy chain consisting of (i) the amino acid sequence of the VH of P1-068767_D52N_E1001F and (ii) the amino acid sequence of SEQ ID NO: 182, and a light chain consisting of the light chain amino acid sequence of P1-068767_D52N_E100fF;

(nnn) a heavy chain consisting of (i) the amino acid sequence of the VH of P1-068767_E100fF and (ii) the amino acid sequence of SEQ ID NO: 182, and a light chain consisting of the light chain amino acid sequence of P1-068767_E100fF;

(ooo) a heavy chain consisting of (i) the amino acid sequence of the VH of P1-068767_E30D_E100fF and (ii) the amino acid sequence of SEQ ID NO: 182, and a light chain consisting of the light chain amino acid sequence of P1-068767_E30D_E100fF;

(ppp) a heavy chain consisting of (i) the amino acid sequence of the VH of P1-061029_F100fE_V102D and (ii) the amino acid sequence of SEQ ID NO: 182, and a light chain consisting of the light chain amino acid sequence of P1-061029_F100fE_V102D;

(qqq) a heavy chain consisting of (i) the amino acid sequence of the VH of P1-061029_F100fE and (ii) the amino acid sequence of SEQ ID NO: 182, and a light chain consisting of the light chain amino acid sequence of P1-061029_F100fE;

(rrr) a heavy chain consisting of (i) the amino acid sequence of the VH of P1-061029_V102D and (ii) the amino acid sequence of SEQ ID NO: 182, and a light chain consisting of the light chain amino acid sequence of P1-061029_V102D;

(sss) a heavy chain consisting of (i) the amino acid sequence of the VH of P1-061029_Y32E and (ii) the amino acid sequence of SEQ ID NO: 182, and a light chain consisting of the light chain amino acid sequence of P1-061029_Y32E; or (ttt) a heavy chain consisting of (i) the amino acid sequence of the VH of P1-061029_Y32E_F100fE and (ii) the amino acid sequence of SEQ ID NO: 182, and a light chain consisting of the light chain amino acid sequence of P1-061029_Y32E_F100fE., wherein the C-terminal amino acid of VH and the N-terminal amino acid of SEQ ID NO: 182 form a peptidic bond; and optionally wherein the VII in any of (a) to (ttt) comprises one or both of the K16R and T84A substitutions.

In some embodiments, the disclosure contemplates anti-VISTA mAbs comprising:

a heavy chain consisting of the amino acid sequences of (i) a VH of (a) to (ttt) listed above, (ii) SEQ ID NO: 182, and (iii) a Lys residue, wherein the C-terminal amino acid of VH and the N-terminal amino acid of SEQ ID NO: 182 form a peptidic bond and wherein the C-terminal amino acid of SEQ ID NO: 182 is joined to the N-terminal of the Lys; and a light chain consisting of the light chain amino acid sequence of (a) to (ttt) listed above;

wherein the VH and light chain amino acid sequences are chosen from the same antibody species from among (a) to (ttt) listed above.

Certain embodiments of this disclosure include anti-VISTA Abs comprising:

(a) a heavy chain comprising (i) the amino acid sequence of the VH of P1-061029 (SEQ ID NO: 67) and (ii) the amino acid sequence of SEQ ID NO: 183, and a light chain comprising the light chain amino acid sequence of P1-061029 (SEQ ID NO: 70);

(b) a heavy chain comprising (i) the amino acid sequence of the VH of P1-061015 and (ii) the amino acid sequence of SEQ ID NO: 183, and a light chain comprising the light chain amino acid sequence of P1-061015;

(c) a heavy chain comprising (i) the amino acid sequence of the VH of P1-068757 and (ii) the amino acid sequence of SEQ ID NO: 183, and a light chain comprising the light chain amino acid sequence of P1-068757;

(d) a heavy chain comprising (i) the amino acid sequence of the VH of P1-068759 and (ii) the amino acid sequence of SEQ ID NO: 183, and a light chain comprising the light chain amino acid sequence of P1-068759;

(e) a heavy chain comprising (i) the amino acid sequence of the VH of P1-068761 and (ii) the amino acid sequence of SEQ ID NO: 183, and a light chain comprising the light chain amino acid sequence of P1-068761;

(f) a heavy chain comprising (i) the amino acid sequence of the VH of P1-068763 and (ii) the amino acid sequence of SEQ ID NO: 183, and a light chain comprising the light chain amino acid sequence of P1-068763;

(g) a heavy chain comprising (i) the amino acid sequence of the VH of P1-068765 and (ii) the amino acid sequence of SEQ ID NO: 183, and a light chain comprising the light chain amino acid sequence of P1-068765;

(h) a heavy chain comprising (i) the amino acid sequence of the VH of P1-068767 and (ii) the amino acid sequence of SEQ ID NO: 183, and a light chain comprising the light chain amino acid sequence of P1-068767;

(i) a heavy chain comprising (i) the amino acid sequence of the VH of P1-068769 and (ii) the amino acid sequence of SEQ ID NO: 183, and a light chain comprising the light chain amino acid sequence of P1-068769;

(j) a heavy chain comprising (i) the amino acid sequence of the VH of P1-068771 and (ii) the amino acid sequence of SEQ ID NO: 183, and a light chain comprising the light chain amino acid sequence of P1-068771;

(k) a heavy chain comprising (i) the amino acid sequence of the VH of P1-068773 and (ii) the amino acid sequence of SEQ ID NO: 183, and a light chain comprising the light chain amino acid sequence of P1-068773;

(l) a heavy chain comprising (i) the amino acid sequence of the VH of P1-068775 and (ii) the amino acid sequence of SEQ ID NO: 183, and a light chain comprising the light chain amino acid sequence of P1-068775;

(m) a heavy chain comprising (i) the amino acid sequence of the VH of P1-069059 and (ii) the amino acid sequence of SEQ ID NO: 183, and a light chain comprising the light chain amino acid sequence of P1-069059;

(n) a heavy chain comprising (i) the amino acid sequence of the VH of P1-069061 and (ii) the amino acid sequence of SEQ ID NO: 183, and a light chain comprising the light chain amino acid sequence of P1-069061;

(o) a heavy chain comprising (i) the amino acid sequence of the VH of P1-069063 and (ii) the amino acid sequence of SEQ ID NO: 183, and a light chain comprising the light chain amino acid sequence of P1-069063;

(p) a heavy chain comprising (i) the amino acid sequence of the VH of P1-069065 and (ii) the amino acid sequence of SEQ ID NO: 183, and a light chain comprising the light chain amino acid sequence of P1-069065;

(q) a heavy chain comprising (i) the amino acid sequence of the VH of P1-069067 and (ii) the amino acid sequence of SEQ ID NO: 183, and a light chain comprising the light chain amino acid sequence of P1-069067;

(r) a heavy chain comprising (i) the amino acid sequence of the VH of P1-069069 and (ii) the amino acid sequence of SEQ ID NO: 183, and a light chain comprising the light chain amino acid sequence of P1-069069;

(s) a heavy chain comprising (i) the amino acid sequence of the VH of P1-069071 and (ii) the amino acid sequence of SEQ ID NO: 183, and a light chain comprising the light chain amino acid sequence of P1-069071;

(t) a heavy chain comprising (i) the amino acid sequence of the VH of P1-069073 and (ii) the amino acid sequence of SEQ ID NO: 183, and a light chain comprising the light chain amino acid sequence of P1-069073;

(u) a heavy chain comprising (i) the amino acid sequence of the VH of P1-069075 and (ii) the amino acid sequence of SEQ ID NO: 183, and a light chain comprising the light chain amino acid sequence of P1-069075;

(v) a heavy chain comprising (i) the amino acid sequence of the VH of P1-069077 and (ii) the amino acid sequence of SEQ ID NO: 183, and a light chain comprising the light chain amino acid sequence of P1-069077;

(w) a heavy chain comprising (i) the amino acid sequence of the VH of P1-068736 and (ii) the amino acid sequence of SEQ ID NO: 183, and a light chain comprising the light chain amino acid sequence of P1-068736;

(x) a heavy chain comprising (i) the amino acid sequence of the VH of P1-068738 and (ii) the amino acid sequence of SEQ ID NO: 183, and a light chain comprising the light chain amino acid sequence of P1-068738;

(y) a heavy chain comprising (i) the amino acid sequence of the VH of P1-068740 and (ii) the amino acid sequence of SEQ ID NO: 183, and a light chain comprising the light chain amino acid sequence of P1-068740;

(z) a heavy chain comprising (i) the amino acid sequence of the VH of P1-068742 and (ii) the amino acid sequence of SEQ ID NO: 183, and a light chain comprising the light chain amino acid sequence of P1-068742;

(aa) a heavy chain comprising (i) the amino acid sequence of the VH of P1-068744 and (ii) the amino acid sequence of SEQ ID NO: 183, and a light chain comprising the light chain amino acid sequence of P1-068744;

(bb) a heavy chain comprising the amino acid sequence of the VH of P1-068746 and (ii) the amino acid sequence of SEQ ID NO: 183, and a light chain comprising the light chain amino acid sequence of P1-068746;

(cc) a heavy chain comprising (i) the amino acid sequence of the VH of P1-068748 and (ii) the amino acid sequence of SEQ ID NO: 183, and a light chain comprising the light chain amino acid sequence of P1-068748;
(dd) a heavy chain comprising (i) the amino acid sequence of the VH of P1-068750 and (ii) the amino acid sequence of SEQ ID NO: 183, and a light chain comprising the light chain amino acid sequence of P1-068750;
(ee) a heavy chain comprising (i) the amino acid sequence of the VH of P1-068752 and (ii) the amino acid sequence of SEQ ID NO: 183, and a light chain comprising the light chain amino acid sequence of P1-068752;
(ff) a heavy chain comprising (i) the amino acid sequence of the VH of P1-068754 and (ii) the amino acid sequence of SEQ ID NO: 183, and a light chain comprising the light chain amino acid sequence of P1-068754;
(gg) a heavy chain comprising (i) the amino acid sequence of the VH of P1-068761_E55A and (ii) the amino acid sequence of SEQ ID NO: 183, and a light chain comprising the light chain amino acid sequence of P1-068761_E55A;
(hh) a heavy chain comprising (i) the amino acid sequence of the VH of P1-068761_H100G and (ii) the amino acid sequence of SEQ ID NO: 183, and a light chain comprising the light chain amino acid sequence of P1-068761_H100G;
(ii) a heavy chain comprising (i) the amino acid sequence of the VH of P1-068761_E56N and (ii) the amino acid sequence of SEQ ID NO: 183, and a light chain comprising the light chain amino acid sequence of P1-068761_E56N;
(jj) a heavy chain comprising (i) the amino acid sequence of the VH of P1-068761_E55A_E56N and (ii) the amino acid sequence of SEQ ID NO: 183, and a light chain comprising the light chain amino acid sequence of P1-068761_E55A E56N;
(kk) a heavy chain comprising (i) the amino acid sequence of the VH of P1-068761_E30D and (ii) the amino acid sequence of SEQ ID NO: 183, and a light chain comprising the light chain amino acid sequence of P1-068761_E30D;
(ll) a heavy chain comprising (i) the amino acid sequence of the VH of P1-068761_E30D_E55A and (ii) the amino acid sequence of SEQ ID NO: 183, and a light chain comprising the light chain amino acid sequence of P1-068761_E30D_E55A;
(mm) a heavy chain comprising (i) the amino acid sequence of the VH of P1-068761_E56N_H100G and (ii) the amino acid sequence of SEQ ID NO: 183, and a light chain comprising the light chain amino acid sequence of P1-068761_E56N_H100G;
(nn) a heavy chain comprising (i) the amino acid sequence of the VH of P1-068761_E30D_H100G and (ii) the amino acid sequence of SEQ ID NO: 183, and a light chain comprising the light chain amino acid sequence of P1-068761_E30D_H100G;
(oo) a heavy chain comprising (i) the amino acid sequence of the VH of P1-068761_E30D_E56N and (ii) the amino acid sequence of SEQ ID NO: 183, and a light chain comprising the light chain amino acid sequence of P1-068761_E30D E56N;
(pp) a heavy chain comprising (i) the amino acid sequence of the VH of P1-068761_E100fF and (ii) the amino acid sequence of SEQ ID NO: 183, and a light chain comprising the light chain amino acid sequence of P1-068761_E100fF;
(qq) a heavy chain comprising (i) the amino acid sequence of the VH of P1-068761_E55A_E100fF and (ii) the amino acid sequence of SEQ ID NO: 183, and a light chain comprising the light chain amino acid sequence of P1-068761_E55A_E100fF;
(rr) a heavy chain comprising (i) the amino acid sequence of the VH of P1-068761_H100G_E100fF and (ii) the amino acid sequence of SEQ ID NO: 183, and a light chain comprising the light chain amino acid sequence of P1-068761_H100G_E100fF;
(ss) a heavy chain comprising (i) the amino acid sequence of the VH of P1-068761_E30D_E100fF and (ii) the amino acid sequence of SEQ ID NO: 183, and a light chain comprising the light chain amino acid sequence of P1-068761_E30D E100fF;
(tt) a heavy chain comprising (i) the amino acid sequence of the VH of P1-068761_E56N_E100fF and (ii) the amino acid sequence of SEQ ID NO: 183, and a light chain comprising the light chain amino acid sequence of P1-068761_E56N_E100fF;
(uu) a heavy chain comprising (i) the amino acid sequence of the VH of P1-068761_E32Y and (ii) the amino acid sequence of SEQ ID NO: 183, and a light chain comprising the light chain amino acid sequence of P1-068761_E32Y;
(vv) a heavy chain comprising (i) the amino acid sequence of the VH of P1-068761_E32Y_E55A and (ii) the amino acid sequence of SEQ ID NO: 183, and a light chain comprising the light chain amino acid sequence of P1-068761_E32Y_E55A;
(ww) a heavy chain comprising (i) the amino acid sequence of the VH of P1-068761_E32Y_E56N and (ii) the amino acid sequence of SEQ ID NO: 183, and a light chain comprising the light chain amino acid sequence of P1-068761_E32Y_E56N;
(xx) a heavy chain comprising (i) the amino acid sequence of the VH of P1-068761_E30D_E32Y and (ii) the amino acid sequence of SEQ ID NO: 183, and a light chain comprising the light chain amino acid sequence of P1-068761_E30D_E32Y;
(yy) a heavy chain comprising (i) the amino acid sequence of the VH of P1-068761_E32Y_H100G and (ii) the amino acid sequence of SEQ ID NO: 183, and a light chain comprising the light chain amino acid sequence of P1-068761_E32Y_H100G;
(zz) a heavy chain comprising (i) the amino acid sequence of the VH of P1-068761_E32Y_E100fF and (ii) the amino acid sequence of SEQ ID NO: 183, and a light chain comprising the light chain amino acid sequence of P1-068761_E32Y_E100fF;
(aaa) a heavy chain comprising (i) the amino acid sequence of the VH of P1-068767_D52N_D102V and (ii) the amino acid sequence of SEQ ID NO: 183, and a light chain comprising the light chain amino acid sequence of P1-068767_D52N_D102V;
(bbb) a heavy chain comprising (i) the amino acid sequence of the VH of P1-068767_D52N and (ii) the amino acid sequence of SEQ ID NO: 183, and a light chain comprising the light chain amino acid sequence of P1-068767_D52N;
(ccc) a heavy chain comprising (i) the amino acid sequence of the VH of P1-068767_D52N_E55A and (ii) the amino acid sequence of SEQ ID NO: 183, and a light chain comprising the light chain amino acid sequence of P1-068767_D52N_E55A;

(ddd) a heavy chain comprising (i) the amino acid sequence of the VH of P1-068767_E55A_D102V and (ii) the amino acid sequence of SEQ ID NO: 183, and a light chain comprising the light chain amino acid sequence of P1-068767_E55A_D102V;

(eee) a heavy chain comprising (i) the amino acid sequence of the VH of P1-068767_D102V and (ii) the amino acid sequence of SEQ ID NO: 183, and a light chain comprising the light chain amino acid sequence of P1-068767_D102V;

(fff) a heavy chain comprising (i) the amino acid sequence of the VH of P1-068767_E55A and (ii) the amino acid sequence of SEQ ID NO: 183, and a light chain comprising the light chain amino acid sequence of P1-068767_E55A;

(ggg) a heavy chain comprising (i) the amino acid sequence of the VH of P1-068767_E30D_D52N and (ii) the amino acid sequence of SEQ ID NO: 183, and a light chain comprising the light chain amino acid sequence of P1-068767_E30D_D52N;

(hhh) a heavy chain comprising (i) the amino acid sequence of the VH of P1-068767_E30D_D102V and (ii) the amino acid sequence of SEQ ID NO: 183, and a light chain comprising the light chain amino acid sequence of P1-068767_E30D_D102V;

(iii) a heavy chain comprising (i) the amino acid sequence of the VH of P1-068767_E30D and (ii) the amino acid sequence of SEQ ID NO: 183, and a light chain comprising the light chain amino acid sequence of P1-068767_E30D;

(jjj) a heavy chain comprising (i) the amino acid sequence of the VH of P1-068767_E30D_E55A and (ii) the amino acid sequence of SEQ ID NO: 183, and a light chain comprising the light chain amino acid sequence of P1-068767_E30D_E55A;

(kkk) a heavy chain comprising (i) the amino acid sequence of the VH of P1-068767_E100fF_D102V and (ii) the amino acid sequence of SEQ ID NO: 183, and a light chain comprising the light chain amino acid sequence of P1-068767_E100fF_D102V;

(lll) a heavy chain comprising (i) the amino acid sequence of the VH of P1-068767_E55A_E100fF and (ii) the amino acid sequence of SEQ ID NO: 183, and a light chain comprising the light chain amino acid sequence of P1-068767_E55A_E100fF;

(mmm) a heavy chain comprising (i) the amino acid sequence of the VH of P1-068767_D52N_E100fF and (ii) the amino acid sequence of SEQ ID NO: 183, and a light chain comprising the light chain amino acid sequence of P1-068767_D52N_E100fF;

(nnn) a heavy chain comprising (i) the amino acid sequence of the VH of P1-068767_E100fF and (ii) the amino acid sequence of SEQ ID NO: 183, and a light chain comprising the light chain amino acid sequence of P1-068767_EM100fF;

(ooo) a heavy chain comprising (i) the amino acid sequence of the VH of P1-068767_E30D_E1001F and (ii) the amino acid sequence of SEQ ID NO: 183, and a light chain comprising the light chain amino acid sequence of P1-068767_E30D_E100fF;

(ppp) a heavy chain comprising (i) the amino acid sequence of the VH of P1-061029_F100fE_V102D and (ii) the amino acid sequence of SEQ ID NO: 183, and a light chain comprising the light chain amino acid sequence of P1-061029_F100fE_V102D;

(qqq) a heavy chain comprising (i) the amino acid sequence of the VH of P1-061029_F100fE and (ii) the amino acid sequence of SEQ ID NO: 183, and a light chain comprising the light chain amino acid sequence of P1-061029_F100fE;

(rrr) a heavy chain comprising (i) the amino acid sequence of the VH of P1-061029_V102D and (ii) the amino acid sequence of SEQ ID NO: 183, and a light chain comprising the light chain amino acid sequence of P1-061029_V102D;

(sss) a heavy chain comprising (i) the amino acid sequence of the VH of P1-061029_Y32E and (ii) the amino acid sequence of SEQ ID NO: 183, and a light chain comprising the light chain amino acid sequence of P1-061029_Y32E; or (ttt) a heavy chain comprising (i) the amino acid sequence of the VH of P1-061029_Y32E_F100E and (ii) the amino acid sequence of SEQ ID NO: 183, and a light chain comprising the light chain amino acid sequence of P1-061029_Y32E_F100fE;

optionally wherein the VH in any of (a) to (ttt) comprises one or both of the K16R and T84A substitutions.

Certain embodiments of this disclosure include anti-VISTA Abs comprising:

(a) a heavy chain consisting of (i) the amino acid sequence of the VH of P1-061029 (SEQ ID NO: 67) and (ii) the amino acid sequence of SEQ ID NO: 183, and a light chain consisting of the light chain amino acid sequence of P1-061029 (SEQ ID NO: 70);

(b) a heavy chain consisting of (i) the amino acid sequence of the VH of P1-061015 and (ii) the amino acid sequence of SEQ ID NO: 183, and a light chain consisting of the light chain amino acid sequence of P1-061015;

(c) a heavy chain consisting of (i) the amino acid sequence of the VH of P1-068757 and (ii) the amino acid sequence of SEQ ID NO: 183, and a light chain consisting of the light chain amino acid sequence of P1-068757;

(d) a heavy chain consisting of (i) the amino acid sequence of the VH of P1-068759 and (ii) the amino acid sequence of SEQ ID NO: 183, and a light chain consisting of the light chain amino acid sequence of P1-068759;

(e) a heavy chain consisting of (i) the amino acid sequence of the VH of P1-068761 and (ii) the amino acid sequence of SEQ ID NO: 183, and a light chain consisting of the light chain amino acid sequence of P1-068761;

(f) a heavy chain consisting of (i) the amino acid sequence of the VH of P1-068763 and (ii) the amino acid sequence of SEQ ID NO: 183, and a light chain consisting of the light chain amino acid sequence of P1-068763;

(g) a heavy chain consisting of (i) the amino acid sequence of the VH of P1-068765 and (ii) the amino acid sequence of SEQ ID NO: 183, and a light chain consisting of the light chain amino acid sequence of P1-068765;

(h) a heavy chain consisting of (i) the amino acid sequence of the VH of P1-068767 and (ii) the amino acid sequence of SEQ ID NO: 183, and a light chain consisting of the light chain amino acid sequence of P1-068767;

(i) a heavy chain consisting of (i) the amino acid sequence of the VH of P1-068769 and (ii) the amino acid sequence of SEQ ID NO: 183, and a light chain consisting of the light chain amino acid sequence of P1-068769;

(j) a heavy chain consisting of (i) the amino acid sequence of the VH of P1-068771 and (ii) the amino acid sequence of SEQ ID NO: 183, and a light chain consisting of the light chain amino acid sequence of P1-068771;

(k) a heavy chain consisting of (i) the amino acid sequence of the VH of P1-068773 and (ii) the amino acid sequence of SEQ ID NO: 183, and a light chain consisting of the light chain amino acid sequence of P1-068773;

(l) a heavy chain consisting of (i) the amino acid sequence of the VH of P1-068775 and (ii) the amino acid sequence of SEQ ID NO: 183, and a light chain consisting of the light chain amino acid sequence of P1-068775;

(m) a heavy chain consisting of (i) the amino acid sequence of the VH of P1-069059 and (ii) the amino acid sequence of SEQ ID NO: 183, and a light chain consisting of the light chain amino acid sequence of P1-069059;

(n) a heavy chain consisting of (i) the amino acid sequence of the VH of P1-069061 and (ii) the amino acid sequence of SEQ ID NO: 183, and a light chain consisting of the light chain amino acid sequence of P1-069061;

(o) a heavy chain consisting of (i) the amino acid sequence of the VH of P1-069063 and (ii) the amino acid sequence of SEQ ID NO: 183, and a light chain consisting of the light chain amino acid sequence of P1-069063;

(p) a heavy chain consisting of (i) the amino acid sequence of the VH of P1-069065 and (ii) the amino acid sequence of SEQ ID NO: 183, and a light chain consisting of the light chain amino acid sequence of P1-069065;

(q) a heavy chain consisting of (i) the amino acid sequence of the VH of P1-069067 and (ii) the amino acid sequence of SEQ ID NO: 183, and a light chain consisting of the light chain amino acid sequence of P1-069067;

(r) a heavy chain consisting of (i) the amino acid sequence of the VH of P1-069069 and (ii) the amino acid sequence of SEQ ID NO: 183, and a light chain consisting of the light chain amino acid sequence of P1-069069;

(s) a heavy chain consisting of (i) the amino acid sequence of the VH of P1-069071 and (ii) the amino acid sequence of SEQ ID NO: 183, and a light chain consisting of the light chain amino acid sequence of P1-069071;

(t) a heavy chain consisting of (i) the amino acid sequence of the VH of P1-069073 and (ii) the amino acid sequence of SEQ ID NO: 183, and a light chain consisting of the light chain amino acid sequence of P1-069073;

(u) a heavy chain consisting of (i) the amino acid sequence of the VH of P1-069075 and (ii) the amino acid sequence of SEQ ID NO: 183, and a light chain consisting of the light chain amino acid sequence of P1-069075;

(v) a heavy chain consisting of (i) the amino acid sequence of the VH of P1-069077 and (ii) the amino acid sequence of SEQ ID NO: 183, and a light chain consisting of the light chain amino acid sequence of P1-069077;

(w) a heavy chain consisting of (i) the amino acid sequence of the VH of P1-068736 and (ii) the amino acid sequence of SEQ ID NO: 183, and a light chain consisting of the light chain amino acid sequence of P1-068736;

(x) a heavy chain consisting of (i) the amino acid sequence of the VH of P1-068738 and (ii) the amino acid sequence of SEQ ID NO: 183, and a light chain consisting of the light chain amino acid sequence of P1-068738;

(y) a heavy chain consisting of (i) the amino acid sequence of the VH of P1-068740 and (ii) the amino acid sequence of SEQ ID NO: 183, and a light chain consisting of the light chain amino acid sequence of P1-068740;

(z) a heavy chain consisting of (i) the amino acid sequence of the VH of P1-068742 and (ii) the amino acid sequence of SEQ ID NO: 183, and a light chain consisting of the light chain amino acid sequence of P1-068742;

(aa) a heavy chain consisting of (i) the amino acid sequence of the VH of P1-068744 and (ii) the amino acid sequence of SEQ ID NO: 183, and a light chain consisting of the light chain amino acid sequence of P1-068744;

(bb) a heavy chain consisting of the amino acid sequence of the VH of P1-068746 and (ii) the amino acid sequence of SEQ ID NO: 183, and a light chain consisting of the light chain amino acid sequence of P1-068746;

(cc) a heavy chain consisting of (i) the amino acid sequence of the VH of P1-068748 and (ii) the amino acid sequence of SEQ ID NO: 183, and a light chain consisting of the light chain amino acid sequence of P1-068748;

(dd) a heavy chain consisting of (i) the amino acid sequence of the VH of P1-068750 and (ii) the amino acid sequence of SEQ ID NO: 183, and a light chain consisting of the light chain amino acid sequence of P1-068750;

(ee) a heavy chain consisting of (i) the amino acid sequence of the VH of P1-068752 and (ii) the amino acid sequence of SEQ ID NO: 183, and a light chain consisting of the light chain amino acid sequence of P1-068752;

(ff) a heavy chain consisting of (i) the amino acid sequence of the VH of P1-068754 and (ii) the amino acid sequence of SEQ ID NO: 183, and a light chain consisting of the light chain amino acid sequence of P1-068754;

(gg) a heavy chain consisting of (i) the amino acid sequence of the VH of P1-068761_E55A and (ii) the amino acid sequence of SEQ ID NO: 183, and a light chain consisting of the light chain amino acid sequence of P1-068761_E55A;

(hh) a heavy chain consisting of (i) the amino acid sequence of the VH of P1-068761_H100G and (ii) the amino acid sequence of SEQ ID NO: 183, and a light chain consisting of the light chain amino acid sequence of P1-068761_H100G;

(ii) a heavy chain consisting of (i) the amino acid sequence of the VH of P1-068761_E56N and (ii) the amino acid sequence of SEQ ID NO: 183, and a light chain consisting of the light chain amino acid sequence of P1-068761_E56N;

(jj) a heavy chain consisting of (i) the amino acid sequence of the VH of P1-068761_E55A_E56N and (ii) the amino acid sequence of SEQ ID NO: 183, and a light chain consisting of the light chain amino acid sequence of P1-068761_E55A_E56N;

(kk) a heavy chain consisting of (i) the amino acid sequence of the VH of P1-068761_E30D and (ii) the amino acid sequence of SEQ ID NO: 183, and a light chain consisting of the light chain amino acid sequence of P1-068761_E30D;

(ll) a heavy chain consisting of (i) the amino acid sequence of the VH of P1-068761_E30D_E55A and (ii) the amino acid sequence of SEQ ID NO: 183, and a light chain consisting of the light chain amino acid sequence of P1-068761_E30D_E55A;

(mm) a heavy chain consisting of (i) the amino acid sequence of the VH of P1-068761_E56N_H100G and (ii) the amino acid sequence of SEQ ID NO: 183, and a light chain consisting of the light chain amino acid sequence of P1-068761_E56N_H100G;

(nn) a heavy chain consisting of (i) the amino acid sequence of the VH of P1-068761_E30D_H100G and (ii) the amino acid sequence of SEQ ID NO: 183, and a light chain consisting of the light chain amino acid sequence of P1-068761_E30D_H100G;

(oo) a heavy chain consisting of (i) the amino acid sequence of the VH of P1-068761_E30D_E56N and (ii) the amino acid sequence of SEQ ID NO: 183, and a light chain consisting of the light chain amino acid sequence of P1-068761_E30D_E56N;

(pp) a heavy chain consisting of (i) the amino acid sequence of the VH of P1-068761_E100fF and (ii) the amino acid sequence of SEQ ID NO: 183, and a light chain consisting of the light chain amino acid sequence of P1-068761_E100fF;

(qq) a heavy chain consisting of (i) the amino acid sequence of the VH of P1-068761_E55A_E100fF and (ii) the amino acid sequence of SEQ ID NO: 183, and a light chain consisting of the light chain amino acid sequence of P1-068761_E55A_E100fF;

(rr) a heavy chain consisting of (i) the amino acid sequence of the VH of P1-068761_H100G_E100fF and (ii) the amino acid sequence of SEQ ID NO: 183, and a light chain consisting of the light chain amino acid sequence of P1-068761-_H100G_E100fF;

(ss) a heavy chain consisting of (i) the amino acid sequence of the VH of P1-068761_E30D_E100fF and (ii) the amino acid sequence of SEQ ID NO: 183, and a light chain consisting of the light chain amino acid sequence of P1-068761_E30D_E100fF;

(tt) a heavy chain consisting of (i) the amino acid sequence of the VH of P1-068761_E56N_E100fF and (ii) the amino acid sequence of SEQ ID NO: 183, and a light chain consisting of the light chain amino acid sequence of P1-068761_E56N_E100fF;

(uu) a heavy chain consisting of (i) the amino acid sequence of the VH of P1-068761_E32Y and (ii) the amino acid sequence of SEQ ID NO: 183, and a light chain consisting of the light chain amino acid sequence of P1-068761_E32Y;

(vv) a heavy chain consisting of (i) the amino acid sequence of the VH of P1-068761_E32Y_E55A and (ii) the amino acid sequence of SEQ ID NO: 183, and a light chain consisting of the light chain amino acid sequence of P1-068761_E32Y_E55A;

(ww) a heavy chain consisting of (i) the amino acid sequence of the VH of P1-068761_E32Y_E56N and (ii) the amino acid sequence of SEQ ID NO: 183, and a light chain consisting of the light chain amino acid sequence of P1-068761_E32Y_E56N;

(xx) a heavy chain consisting of (i) the amino acid sequence of the VH of P1-068761_E30D_E32Y and (ii) the amino acid sequence of SEQ ID NO: 183, and a light chain consisting of the light chain amino acid sequence of P1-068761_E30D_E32Y;

(yy) a heavy chain consisting of (i) the amino acid sequence of the VH of P1-068761_E32Y_H100G and (ii) the amino acid sequence of SEQ ID NO: 183, and a light chain consisting of the light chain amino acid sequence of P1-068761_E32Y_H100G;

(zz) a heavy chain consisting of (i) the amino acid sequence of the VH of P1-068761_E32Y_E100fF and (ii) the amino acid sequence of SEQ ID NO: 183, and a light chain consisting of the light chain amino acid sequence of P1-068761_E32Y_E100fF;

(aaa) a heavy chain consisting of (i) the amino acid sequence of the VH of P1-068767_D52N_D102V and (ii) the amino acid sequence of SEQ ID NO: 183, and a light chain consisting of the light chain amino acid sequence of P1-068767_D52N_D102V;

(bbb) a heavy chain consisting of (i) the amino acid sequence of the VH of P1-068767_D52N and (ii) the amino acid sequence of SEQ ID NO: 183, and a light chain consisting of the light chain amino acid sequence of P1-068767_D52N;

(ccc) a heavy chain consisting of (i) the amino acid sequence of the VH of P1-068767_D52N_E55A and (ii) the amino acid sequence of SEQ ID NO: 183, and a light chain consisting of the light chain amino acid sequence of P1-068767_D52N_E55A;

(ddd) a heavy chain consisting of (i) the amino acid sequence of the VH of P1-068767_E55A_D102V and (ii) the amino acid sequence of SEQ ID NO: 183, and a light chain consisting of the light chain amino acid sequence of P1-068767_E55A_D102V;

(eee) a heavy chain consisting of (i) the amino acid sequence of the VH of P1-068767_D102V and (ii) the amino acid sequence of SEQ ID NO: 183, and a light chain consisting of the light chain amino acid sequence of P1-068767_D102V;

(fff) a heavy chain consisting of (i) the amino acid sequence of the VH of P1-068767_E55A and (ii) the amino acid sequence of SEQ ID NO: 183, and a light chain consisting of the light chain amino acid sequence of P1-068767_E55A;

(ggg) a heavy chain consisting of (i) the amino acid sequence of the VH of P1-068767_E30D_D52N and (ii) the amino acid sequence of SEQ ID NO: 183, and a light chain consisting of the light chain amino acid sequence of P1-068767_E30D_D52N;

(hhh) a heavy chain consisting of (i) the amino acid sequence of the VH of P1-068767_E30D_D102V and (ii) the amino acid sequence of SEQ ID NO: 183, and a light chain consisting of the light chain amino acid sequence of P1-068767_E30D_D102V;

(iii) a heavy chain consisting of (i) the amino acid sequence of the VH of P1-068767_E30D and (ii) the amino acid sequence of SEQ ID NO: 183, and a light chain consisting of the light chain amino acid sequence of P1-068767_E30D;

(jjj) a heavy chain consisting of (i) the amino acid sequence of the VH of P1-068767_E30D_E55A and (ii) the amino acid sequence of SEQ ID NO: 183, and a light chain consisting of the light chain amino acid sequence of P1-068767_E30D_E55A;

(kkk) a heavy chain consisting of (i) the amino acid sequence of the VH of P1-068767_E100fF_D102V and (ii) the amino acid sequence of SEQ ID NO: 183, and a light chain consisting of the light chain amino acid sequence of P1-068767_E100fF_D102V;

(lll) a heavy chain consisting of (i) the amino acid sequence of the VH of P1-068767_E55A_E100fF and (ii) the amino acid sequence of SEQ ID NO: 183, and a light chain consisting of the light chain amino acid sequence of P1-068767_E55A_E100fF;

(mmm) a heavy chain consisting of (i) the amino acid sequence of the VH of P1-068767_D52N_E100fF and (ii) the amino acid sequence of SEQ ID NO: 183, and a light chain consisting of the light chain amino acid sequence of P1-068767_D52N_E100fF;

(nnn) a heavy chain consisting of (i) the amino acid sequence of the VH of P1-068767_E100fF and (ii) the amino acid sequence of SEQ ID NO: 183, and a light chain consisting of the light chain amino acid sequence of P1-068767_E100fF;

(ooo) a heavy chain consisting of (i) the amino acid sequence of the VH of P1-068767_E30D_E100fF and (ii) the amino acid sequence of SEQ ID NO: 183, and a light chain consisting of the light chain amino acid sequence of P1-068767_E30D_E100fF;

(ppp) a heavy chain consisting of (i) the amino acid sequence of the VH of P1-061029_F100fE_V102D and (ii) the amino acid sequence of SEQ ID NO: 183, and a light chain consisting of the light chain amino acid sequence of P1-061029_F100fE_V102D;

(qqq) a heavy chain consisting of (i) the amino acid sequence of the VH of P1-061029_F100fE and (ii) the amino acid sequence of SEQ ID NO: 183, and a light chain consisting of the light chain amino acid sequence of P1-061029_F100fE;

(rrr) a heavy chain consisting of (i) the amino acid sequence of the VH of P1-061029_V102D and (ii) the amino acid sequence of SEQ ID NO: 183, and a light chain consisting of the light chain amino acid sequence of P1-061029_V102D;

(sss) a heavy chain consisting of (i) the amino acid sequence of the VH of P1-061029_Y32E and (ii) the amino acid sequence of SEQ ID NO: 183, and a light chain consisting of the light chain amino acid sequence of P1-061029 Y32E; or (ttt) a heavy chain consisting of (i) the amino acid sequence of the VH of P1-061029_Y32E_F100fE and (ii) the amino acid sequence of SEQ ID NO: 183, and a light chain consisting of the light chain amino acid sequence of P1-061029 Y32E_F100fE.

wherein the C-terminal amino acid of VH and the N-terminal amino acid of SEQ ID NO: 183 form a peptidic bond; and optionally wherein the VH in any of (a) to (ttt) comprises one or both of the K16R and T84A substitutions.

In some embodiments, the disclosure contemplates anti-VISTA mAbs comprising:

a heavy chain consisting of the amino acid sequences of (i) a VH of (a) to (ttt) listed above, (ii) SEQ ID NO: 183, and (iii) a Lys residue, wherein the C-terminal amino acid of VH and the N-terminal amino acid of SEQ ID NO: 183 form a peptidic bond and wherein the C-terminal amino acid of SEQ ID NO: 183 is joined to the N-terminal of the Lys; and a light chain consisting of the light chain amino acid sequence of (a) to (ttt) listed above;

wherein the VH and light chain amino acid sequences are chosen from the same antibody species from among (a) to (ttt) listed above.

Further embodiments of this disclosure include anti-VISTA Abs comprising:

(a) a heavy chain comprising (i) the amino acid sequence of the VH of P1-061029 (SEQ ID NO: 67) and (ii) the amino acid sequence of SEQ ID NO: 184, and a light chain comprising the light chain amino acid sequence of P1-061029 (SEQ ID NO: 70);

(b) a heavy chain comprising (i) the amino acid sequence of the VH of P1-061015 and (ii) the amino acid sequence of SEQ ID NO: 184, and a light chain comprising the light chain amino acid sequence of P1-061015;

(c) a heavy chain comprising (i) the amino acid sequence of the VH of P1-068757 and (ii) the amino acid sequence of SEQ ID NO: 184, and a light chain comprising the light chain amino acid sequence of P1-068757;

(d) a heavy chain comprising (i) the amino acid sequence of the VH of P1-068759 and (ii) the amino acid sequence of SEQ ID NO: 184, and a light chain comprising the light chain amino acid sequence of P1-068759;

(e) a heavy chain comprising (i) the amino acid sequence of the VH of P1-068761 and (ii) the amino acid sequence of SEQ ID NO: 184, and a light chain comprising the light chain amino acid sequence of P1-068761;

(f) a heavy chain comprising (i) the amino acid sequence of the VH of P1-068763 and (ii) the amino acid sequence of SEQ ID NO: 184, and a light chain comprising the light chain amino acid sequence of P1-068763;

(g) a heavy chain comprising (i) the amino acid sequence of the VH of P1-068765 and (ii) the amino acid sequence of SEQ ID NO: 184, and a light chain comprising the light chain amino acid sequence of P1-068765;

(h) a heavy chain comprising (i) the amino acid sequence of the VH of P1-068767 and (ii) the amino acid sequence of SEQ ID NO: 184, and a light chain comprising the light chain amino acid sequence of P1-068767;

(i) a heavy chain comprising (i) the amino acid sequence of the VH of P1-068769 and (ii) the amino acid sequence of SEQ ID NO: 184, and a light chain comprising the light chain amino acid sequence of P1-068769;

(j) a heavy chain comprising (i) the amino acid sequence of the VH of P1-068771 and (ii) the amino acid sequence of SEQ ID NO: 184, and a light chain comprising the light chain amino acid sequence of P1-068771;

(k) a heavy chain comprising (i) the amino acid sequence of the VH of P1-068773 and (ii) the amino acid sequence of SEQ ID NO: 184, and a light chain comprising the light chain amino acid sequence of P1-068773;

(l) a heavy chain comprising (i) the amino acid sequence of the VH of P1-068775 and (ii) the amino acid sequence of SEQ ID NO: 184, and a light chain comprising the light chain amino acid sequence of P1-068775;

(m) a heavy chain comprising (i) the amino acid sequence of the VH of P1-069059 and (ii) the amino acid sequence of SEQ ID NO: 184, and a light chain comprising the light chain amino acid sequence of P1-069059;

(n) a heavy chain comprising (i) the amino acid sequence of the VH of P1-069061 and (ii) the amino acid sequence of SEQ ID NO: 184, and a light chain comprising the light chain amino acid sequence of P1-069061;

(o) a heavy chain comprising (i) the amino acid sequence of the VH of P1-069063 and (ii) the amino acid sequence of SEQ ID NO: 184, and a light chain comprising the light chain amino acid sequence of P1-069063;

(p) a heavy chain comprising (i) the amino acid sequence of the VH of P1-069065 and (ii) the amino acid sequence of SEQ ID NO: 184, and a light chain comprising the light chain amino acid sequence of P1-069065;

(q) a heavy chain comprising (i) the amino acid sequence of the VH of P1-069067 and (ii) the amino acid sequence of SEQ ID NO: 184, and a light chain comprising the light chain amino acid sequence of P1-069067;

(r) a heavy chain comprising (i) the amino acid sequence of the VH of P1-069069 and (ii) the amino acid sequence of SEQ ID NO: 184, and a light chain comprising the light chain amino acid sequence of P1-069069;

(s) a heavy chain comprising (i) the amino acid sequence of the VH of P1-069071 and (ii) the amino acid sequence of SEQ ID NO: 184, and a light chain comprising the light chain amino acid sequence of P1-069071;

(t) a heavy chain comprising (i) the amino acid sequence of the VH of P1-069073 and (ii) the amino acid sequence of SEQ ID NO: 184, and a light chain comprising the light chain amino acid sequence of P1-069073;

(u) a heavy chain comprising (i) the amino acid sequence of the VH of P1-069075 and (ii) the amino acid sequence of SEQ ID NO: 184, and a light chain comprising the light chain amino acid sequence of P1-069075;

(v) a heavy chain comprising (i) the amino acid sequence of the VH of P1-069077 and (ii) the amino acid sequence of SEQ ID NO: 184, and a light chain comprising the light chain amino acid sequence of P1-069077;

(w) a heavy chain comprising (i) the amino acid sequence of the VH of P1-068736 and (ii) the amino acid sequence of SEQ ID NO: 184, and a light chain comprising the light chain amino acid sequence of P1-068736;

(x) a heavy chain comprising (i) the amino acid sequence of the VH of P1-068738 and (ii) the amino acid sequence of SEQ ID NO: 184, and a light chain comprising the light chain amino acid sequence of P1-068738;

(y) a heavy chain comprising (i) the amino acid sequence of the VH of P1-068740 and (ii) the amino acid sequence of SEQ ID NO: 184, and a light chain comprising the light chain amino acid sequence of P1-068740;

(z) a heavy chain comprising (i) the amino acid sequence of the VH of P1-068742 and (ii) the amino acid sequence of SEQ ID NO: 184, and a light chain comprising the light chain amino acid sequence of P1-068742;

(aa) a heavy chain comprising (i) the amino acid sequence of the VH of P1-068744 and (ii) the amino acid sequence of SEQ ID NO: 184, and a light chain comprising the light chain amino acid sequence of P1-068744;

(bb) a heavy chain comprising the amino acid sequence of the VH of P1-068746 and (ii) the amino acid sequence of SEQ ID NO: 184, and a light chain comprising the light chain amino acid sequence of P1-068746;

(cc) a heavy chain comprising (i) the amino acid sequence of the VH of P1-068748 and (ii) the amino acid sequence of SEQ ID NO: 184, and a light chain comprising the light chain amino acid sequence of P1-068748;

(dd) a heavy chain comprising (i) the amino acid sequence of the VH of P1-068750 and (ii) the amino acid sequence of SEQ ID NO: 184, and a light chain comprising the light chain amino acid sequence of P1-068750;

(ee) a heavy chain comprising (i) the amino acid sequence of the VH of P1-068752 and (ii) the amino acid sequence of SEQ ID NO: 184, and a light chain comprising the light chain amino acid sequence of P1-068752;

(ff) a heavy chain comprising (i) the amino acid sequence of the VH of P1-068754 and (ii) the amino acid sequence of SEQ ID NO: 184, and a light chain comprising the light chain amino acid sequence of P1-068754;

(gg) a heavy chain comprising (i) the amino acid sequence of the VH of P1-068761_E55A and (ii) the amino acid sequence of SEQ ID NO: 184, and a light chain comprising the light chain amino acid sequence of P1-068761_E55A;

(hh) a heavy chain comprising (i) the amino acid sequence of the VH of P1-068761_H100G and (ii) the amino acid sequence of SEQ ID NO: 184, and a light chain comprising the light chain amino acid sequence of P1-068761_H100G;

(ii) a heavy chain comprising (i) the amino acid sequence of the VH of P1-068761_E56N and (ii) the amino acid sequence of SEQ ID NO: 184, and a light chain comprising the light chain amino acid sequence of P1-068761_E56N;

(jj) a heavy chain comprising (i) the amino acid sequence of the VH of P1-068761_E55A_E56N and (ii) the amino acid sequence of SEQ ID NO: 184, and a light chain comprising the light chain amino acid sequence of P1-068761_E55A_E56N;

(kk) a heavy chain comprising (i) the amino acid sequence of the VH of P1-068761_E30D and (ii) the amino acid sequence of SEQ ID NO: 184, and a light chain comprising the light chain amino acid sequence of P1-068761_E30D;

(ll) a heavy chain comprising (i) the amino acid sequence of the VH of P1-068761_E30D_E55A and (ii) the amino acid sequence of SEQ ID NO: 184, and a light chain comprising the light chain amino acid sequence of P1-068761_E30D_E55A;

(mm) a heavy chain comprising (i) the amino acid sequence of the VH of P1-068761_E56N_H100G and (ii) the amino acid sequence of SEQ ID NO: 184, and a light chain comprising the light chain amino acid sequence of P1-068761_E56N_H100G;
(nn) a heavy chain comprising (i) the amino acid sequence of the VH of P1-068761_E30D_H100G and (ii) the amino acid sequence of SEQ ID NO: 184, and a light chain comprising the light chain amino acid sequence of P1-068761_E30D_H100G;
(oo) a heavy chain comprising (i) the amino acid sequence of the VH of P1-068761_E30D_E56N and (ii) the amino acid sequence of SEQ ID NO: 184, and a light chain comprising the light chain amino acid sequence of P1-068761_E30D_E56N;
(pp) a heavy chain comprising (i) the amino acid sequence of the VH of P1-068761_E100fF and (ii) the amino acid sequence of SEQ ID NO: 184, and a light chain comprising the light chain amino acid sequence of P1-068761_E100fF;
(qq) a heavy chain comprising (i) the amino acid sequence of the VH of P1-068761_E55A_E100fF and (ii) the amino acid sequence of SEQ ID NO: 184, and a light chain comprising the light chain amino acid sequence of P1-068761_E55A_E100fF;
(rr) a heavy chain comprising (i) the amino acid sequence of the VH of P1-068761_H100G_E100fF and (ii) the amino acid sequence of SEQ ID NO: 184, and a light chain comprising the light chain amino acid sequence of P1-068761_H100G_E100fF;
(ss) a heavy chain comprising (i) the amino acid sequence of the VH of P1-068761_E30D_E100fF and (ii) the amino acid sequence of SEQ ID NO: 184, and a light chain comprising the light chain amino acid sequence of P1-068761_E30D_E100fF;
(tt) a heavy chain comprising (i) the amino acid sequence of the VH of P1-068761_E56N_E100fF and (ii) the amino acid sequence of SEQ ID NO: 184, and a light chain comprising the light chain amino acid sequence of P1-068761_E56N_E100fF;
(uu) a heavy chain comprising (i) the amino acid sequence of the VH of P1-068761_E32Y and (ii) the amino acid sequence of SEQ ID NO: 184, and a light chain comprising the light chain amino acid sequence of P1-068761_E32Y;
(vv) a heavy chain comprising (i) the amino acid sequence of the VH of P1-068761_E32Y_E55A and (ii) the amino acid sequence of SEQ ID NO: 184, and a light chain comprising the light chain amino acid sequence of P1-068761_E32Y_E55A;
(ww) a heavy chain comprising (i) the amino acid sequence of the VH of P1-068761_E32Y_E56N and (ii) the amino acid sequence of SEQ ID NO: 184, and a light chain comprising the light chain amino acid sequence of P1-068761_E32Y_E56N;
(xx) a heavy chain comprising (i) the amino acid sequence of the VH of P1-068761_E30D_E32Y and (ii) the amino acid sequence of SEQ ID NO: 184, and a light chain comprising the light chain amino acid sequence of P1-068761_E30D_E32V;
(yy) a heavy chain comprising (i) the amino acid sequence of the VH of P1-068761_E32Y_H100G and (ii) the amino acid sequence of SEQ ID NO: 184, and a light chain comprising the light chain amino acid sequence of P1-068761_E32Y_H100G;
(zz) a heavy chain comprising (i) the amino acid sequence of the VH of P1-068761_E32Y_E100fF and (ii) the amino acid sequence of SEQ ID NO: 184, and a light chain comprising the light chain amino acid sequence of P1-068761_E32Y_E100fF;
(aaa) a heavy chain comprising (i) the amino acid sequence of the VH of P1-068767_D52N_D102V and (ii) the amino acid sequence of SEQ ID NO: 184, and a light chain comprising the light chain amino acid sequence of P1-068767_D52N_D102V;
(bbb) a heavy chain comprising (i) the amino acid sequence of the VH of P1-068767_D52N and (ii) the amino acid sequence of SEQ ID NO: 184, and a light chain comprising the light chain amino acid sequence of P1-068767_D52N;
(ccc) a heavy chain comprising (i) the amino acid sequence of the VH of P1-068767_D52N_E55A and (ii) the amino acid sequence of SEQ ID NO: 184, and a light chain comprising the light chain amino acid sequence of P1-068767_D52N_E55A;
(ddd) a heavy chain comprising (i) the amino acid sequence of the VH of P1-068767_E55A_D102V and (ii) the amino acid sequence of SEQ ID NO: 184, and a light chain comprising the light chain amino acid sequence of P1-068767_E55A_D102V;
(eee) a heavy chai comprising (i) the amino acid sequence of the VH of P1-068767_D102V and (ii) the amino acid sequence of SEQ ID NO: 184, and a light chain comprising the light chain amino acid sequence of P1-068767_D102V;
(fff) a heavy chain comprising (i) the amino acid sequence of the VH of P1-068767_E55A and (ii) the amino acid sequence of SEQ ID NO: 184, and a light chain comprising the light chain amino acid sequence of P1-068767_E55A;
(ggg) a heavy chain comprising (i) the amino acid sequence of the VH of P1-068767_E30D_D52N and (ii) the amino acid sequence of SEQ ID NO: 184, and a light chain comprising the light chain amino acid sequence of P1-068767_E30D_D52N;
(hhh) a heavy chain comprising (i) the amino acid sequence of the VH of P1-068767_E30D_D102V and (ii) the amino acid sequence of SEQ ID NO: 184, and a light chain comprising the light chain amino acid sequence of P1-068767_E30D_D102V;
(iii) a heavy chain comprising (i) the amino acid sequence of the VH of P1-068767_E30D and (ii) the amino acid sequence of SEQ ID NO: 184, and a light chain comprising the light chain amino acid sequence of P1-068767 E30D;
(jjj) a heavy chain comprising (i) the amino acid sequence of the VH of P1-068767_E30D_E55A and (ii) the amino acid sequence of SEQ ID NO: 184, and a light chain comprising the light chain amino acid sequence of P1-068767_E30D_E55A;
(kkk) a heavy chain comprising (i) the amino acid sequence of the VH of P1-068767_E100fF_D102V and (ii) the amino acid sequence of SEQ ID NO: 184, and a light chain comprising the light chain amino acid sequence of P1-068767_E100fF_D102V;
(lll) a heavy chain comprising (i) the amino acid sequence of the VH of P1-068767_E55A_E100fF and (ii) the amino acid sequence of SEQ ID NO: 184, and a light chain comprising the light chain amino acid sequence of P1-068767_E55A_E100fF;
(mmm) a heavy chain comprising (i) the amino acid sequence of the VH of P1-068767_D52N_E100fF and (ii) the amino acid sequence of SEQ ID NO: 184, and a light chain comprising the light chain amino acid sequence of P1-068767_D52N_E100fF;

(nnn) a heavy chain comprising (i) the amino acid sequence of the VH of P1-068767_E100fF and (ii) the amino acid sequence of SEQ ID NO: 184, and a light chain comprising the light chain amino acid sequence of P1-068767_E100fF;

(ooo) a heavy chain comprising (i) the amino acid sequence of the VH of P1-068767_E30D_E100fF and (ii) the amino acid sequence of SEQ ID NO: 184, and a light chain comprising the light chain amino acid sequence of P1-068767_E30D_E100fF;

(ppp) a heavy chain comprising (i) the amino acid sequence of the VH of P1-061029_F100fE_V102D and (ii) the amino acid sequence of SEQ ID NO: 184, and a light chain comprising the light chain amino acid sequence of P1-061029_F100fE_V102D;

(qqq) a heavy chain comprising (i) the amino acid sequence of the VH of P1-061029_F100fE and (ii) the amino acid sequence of SEQ ID NO: 184, and a light chain comprising the light chain amino acid sequence of P1-061029_F100fE;

(rrr) a heavy chain comprising (i) the amino acid sequence of the VH of P1-061029_V102D and (ii) the amino acid sequence of SEQ ID NO: 184, and a light chain comprising the light chain amino acid sequence of P1-061029_V102D;

(sss) a heavy chain comprising (i) the amino acid sequence of the VH of P1-061029_Y32E and (ii) the amino acid sequence of SEQ ID NO: 184, and a light chain comprising the light chain amino acid sequence of P1-061029_Y32E; or (ttt) a heavy chain comprising (i) the amino acid sequence of the VH of P1-061029_Y32E_F100fE and (ii) the amino acid sequence of SEQ ID NO: 184, and a light chain comprising the light chain amino acid sequence of P1-061029_Y32E_F100fE; and optionally wherein the VH in any of (a) to (ttt) comprises one or both of the K16R and T84A substitutions.

Yet further embodiments of this disclosure include anti-VISTA Abs comprising:

(a) a heavy chain consisting of (i) the amino acid sequence of the VH of P1-061029 (SEQ ID NO: 67) and (ii) the amino acid sequence of SEQ ID NO: 184, and a light chain consisting of the light chain amino acid sequence of P1-061029 (SEQ ID NO: 70);

(b) a heavy chain consisting of (i) the amino acid sequence of the VH of P1-061015 and (ii) the amino acid sequence of SEQ ID NO: 184, and a light chain consisting of the light chain amino acid sequence of P1-061015;

(c) a heavy chain consisting of (i) the amino acid sequence of the VH of P1-068757 and (ii) the amino acid sequence of SEQ ID NO: 184, and a light chain consisting of the light chain amino acid sequence of P1-068757;

(d) a heavy chain consisting of (i) the amino acid sequence of the VH of P1-068759 and (ii) the amino acid sequence of SEQ ID NO: 184, and a light chain consisting of the light chain amino acid sequence of P1-068759;

(e) a heavy chain consisting of (i) the amino acid sequence of the VH of P1-068761 and (ii) the amino acid sequence of SEQ ID NO: 184, and a light chain consisting of the light chain amino acid sequence of P1-068761;

(f) a heavy chain consisting of (i) the amino acid sequence of the VH of P1-068763 and (ii) the amino acid sequence of SEQ ID NO: 184, and a light chain consisting of the light chain amino acid sequence of P1-068763;

(g) a heavy chain consisting of (i) the amino acid sequence of the VH of P1-068765 and (ii) the amino acid sequence of SEQ ID NO: 184, and a light chain consisting of the light chain amino acid sequence of P1-068765;

(h) a heavy chain consisting of (i) the amino acid sequence of the VH of P1-068767 and (ii) the amino acid sequence of SEQ ID NO: 184, and a light chain consisting of the light chain amino acid sequence of P1-068767;

(i) a heavy chain consisting of (i) the amino acid sequence of the VH of P1-068769 and (ii) the amino acid sequence of SEQ ID NO: 184, and a light chain consisting of the light chain amino acid sequence of P1-068769;

(j) a heavy chain consisting of (i) the amino acid sequence of the VH of P1-068771 and (ii) the amino acid sequence of SEQ ID NO: 184, and a light chain consisting of the light chain amino acid sequence of P1-068771;

(k) a heavy chain consisting of (i) the amino acid sequence of the VH of P1-068773 and (ii) the amino acid sequence of SEQ ID NO: 184, and a light chain consisting of the light chain amino acid sequence of P1-068773;

(l) a heavy chain consisting of (i) the amino acid sequence of the VH of P1-068775 and (ii) the amino acid sequence of SEQ ID NO: 184, and a light chain consisting of the light chain amino acid sequence of P1-068775;

(m) a heavy chain consisting of (i) the amino acid sequence of the VH of P1-069059 and (ii) the amino acid sequence of SEQ ID NO: 184, and a light chain consisting of the light chain amino acid sequence of P1-069059;

(n) a heavy chain consisting of (i) the amino acid sequence of the VH of P1-069061 and (ii) the amino acid sequence of SEQ ID NO: 184, and a light chain consisting of the light chain amino acid sequence of P1-069061;

(o) a heavy chain consisting of (i) the amino acid sequence of the VH of P1-069063 and (ii) the amino acid sequence of SEQ ID NO: 184, and a light chain consisting of the light chain amino acid sequence of P1-069063;

(p) a heavy chain consisting of (i) the amino acid sequence of the VH of P1-069065 and (ii) the amino acid sequence of SEQ ID NO: 184, and a light chain consisting of the light chain amino acid sequence of P1-069065;

(q) a heavy chain consisting of (i) the amino acid sequence of the VH of P1-069067 and (ii) the amino acid sequence of SEQ ID NO: 184, and a light chain consisting of the light chain amino acid sequence of P1-069067;

(r) a heavy chain consisting of (i) the amino acid sequence of the VH of P1-069069 and (ii) the amino acid sequence of SEQ ID NO: 184, and a light chain consisting of the light chain amino acid sequence of P1-069069;

(s) a heavy chain consisting of (i) the amino acid sequence of the VH of P1-069071 and (ii) the amino acid sequence of SEQ ID NO: 184, and a light chain consisting of the light chain amino acid sequence of P1-069071;

(t) a heavy chain consisting of (i) the amino acid sequence of the VH of P1-069073 and (ii) the amino acid sequence of SEQ ID NO: 184, and a light chain consisting of the light chain amino acid sequence of P1-069073;

(u) a heavy chain consisting of (i) the amino acid sequence of the VH of P1-069075 and (ii) the amino acid sequence of SEQ ID NO: 184, and a light chain consisting of the light chain amino acid sequence of P1-069075;

(v) a heavy chain consisting of (i) the amino acid sequence of the VH of P1-069077 and (ii) the amino acid sequence of SEQ ID NO: 184, and a light chain consisting of the light chain amino acid sequence of P1-069077;

(w) a heavy chain consisting of (i) the amino acid sequence of the VH of P1-068736 and (ii) the amino acid sequence of SEQ ID NO: 184, and a light chain consisting of the light chain amino acid sequence of P1-068736;

(x) a heavy chain consisting of (i) the amino acid sequence of the VH of P1-068738 and (ii) the amino acid sequence of SEQ ID NO: 184, and a light chain consisting of the light chain amino acid sequence of P1-068738;

(y) a heavy chain consisting of (i) the amino acid sequence of the VH of P1-068740 and (ii) the amino acid sequence of SEQ ID NO: 184, and a light chain consisting of the light chain amino acid sequence of P1-068740;

(z) a heavy chain consisting of (i) the amino acid sequence of the VH of P1-068742 and (ii) the amino acid sequence of SEQ ID NO: 184, and a light chain consisting of the light chain amino acid sequence of P1-068742;

(aa) a heavy chain consisting of (i) the amino acid sequence of the VH of P1-068744 and (ii) the amino acid sequence of SEQ ID NO: 184, and a light chain consisting of the light chain amino acid sequence of P1-068744;

(bb) a heavy chain consisting of the amino acid sequence of the VH of P1-068746 and (ii) the amino acid sequence of SEQ ID NO: 184, and a light chain consisting of the light chain amino acid sequence of P1-068746;

(cc) a heavy chain consisting of (i) the amino acid sequence of the VH of P1-068748 and (ii) the amino acid sequence of SEQ ID NO: 184, and a light chain consisting of the light chain amino acid sequence of P1-068748;

(dd) a heavy chain consisting of (i) the amino acid sequence of the VH of P1-068750 and (ii) the amino acid sequence of SEQ ID NO: 184, and a light chain consisting of the light chain amino acid sequence of P1-068750;

(ee) a heavy chain consisting of (i) the amino acid sequence of the VH of P1-068752 and (ii) the amino acid sequence of SEQ ID NO: 184, and a light chain consisting of the light chain amino acid sequence of P1-068752;

(ff) a heavy chain consisting of (i) the amino acid sequence of the VH of P1-068754 and (ii) the amino acid sequence of SEQ ID NO: 184, and a light chain consisting of the light chain amino acid sequence of P1-068754;

(gg) a heavy chain consisting of (i) the amino acid sequence of the VH of P1-068761_E55A and (ii) the amino acid sequence of SEQ ID NO: 184, and a light chain consisting of the light chain amino acid sequence of P1-068761_E55A;

(hh) a heavy chain consisting of (i) the amino acid sequence of the VH of P1-068761_H100G and (ii) the amino acid sequence of SEQ ID NO: 184, and a light chain consisting of the light chain amino acid sequence of P1-068761_H100G;

(ii) a heavy chain consisting of (i) the amino acid sequence of the VH of P1-068761_E56N and (ii) the amino acid sequence of SEQ ID NO: 184, and a light chain consisting of the light chain amino acid sequence of P1-068761_E56N;

(jj) a heavy chain consisting of (i) the amino acid sequence of the VH of P1-068761_E55A_E56N and (ii) the amino acid sequence of SEQ ID NO: 184, and a light chain consisting of the light chain amino acid sequence of P1-068761_E55A_E56N;

(kk) a heavy chain consisting of (i) the amino acid sequence of the VH of P1-068761_E30D and (ii) the amino acid sequence of SEQ ID NO: 184, and a light chain consisting of the light chain amino acid sequence of P1-068761_E30D;

(ll) a heavy chain consisting of (i) the amino acid sequence of the VH of P1-068761_E30D_E55A and (ii) the amino acid sequence of SEQ ID NO: 184, and a light chain consisting of the light chain amino acid sequence of P1-068761_E30D_E55A;

(mm) a heavy chain consisting of (i) the amino acid sequence of the VH of P1-068761_E56N_H100G and (ii) the amino acid sequence of SEQ ID NO: 184, and a light chain consisting of the light chain amino acid sequence of P1-068761_E56N_H100G;

(nn) a heavy chain consisting of (i) the amino acid sequence of the VH of P1-068761_E30D_H100G and (ii) the amino acid sequence of SEQ ID NO: 184, and a light chain consisting of the light chain amino acid sequence of P1-068761_E30D_H100G;

(oo) a heavy chain consisting of (i) the amino acid sequence of the VH of P1-068761_E30D_E56N and (ii) the amino acid sequence of SEQ ID NO: 184, and a light chain consisting of the light chain amino acid sequence of P1-068761_E30D_E56N;

(pp) a heavy chain consisting of (i) the amino acid sequence of the VH of P1-068761_E100fF and (ii) the amino acid sequence of SEQ ID NO: 184, and a light chain consisting of the light chain amino acid sequence of P1-068761_E100fF;

(qq) a heavy chain consisting of (i) the amino acid sequence of the VH of P1-068761_E55A_E100fF and (ii) the amino acid sequence of SEQ ID NO: 184, and a light chain consisting of the light chain amino acid sequence of P1-068761_E55A_E100fF;

(rr) a heavy chain consisting of (i) the amino acid sequence of the VH of P1-068761_H100G_E100fF and (ii) the amino acid sequence of SEQ ID NO: 184, and a light chain consisting of the light chain amino acid sequence of P1-068761_H100G_E100fF;

(ss) a heavy chain consisting of (i) the amino acid sequence of the VH of P1-068761_E30D_E100fF and (ii) the amino acid sequence of SEQ ID NO: 184, and a light chain consisting of the light chain amino acid sequence of P1-068761_E30D_E100fF;

(tt) a heavy chain consisting of (i) the amino acid sequence of the VH of P1-068761_E56N_E100fF and (ii) the amino acid sequence of SEQ ID NO: 184, and a light chain consisting of the light chain amino acid sequence of P1-068761_E56N_E100fF;

(uu) a heavy chain consisting of (i) the amino acid sequence of the VH of P1-068761_E32Y and (ii) the amino acid sequence of SEQ ID NO: 184, and a light chain consisting of the light chain amino acid sequence of P1-068761_E32Y;

(vv) a heavy chain consisting of (i) the amino acid sequence of the VH of P1-068761_E32Y_E55A and (ii) the amino acid sequence of SEQ ID NO: 184, and a light chain consisting of the light chain amino acid sequence of P1-068761_E32Y_E55A;

(ww) a heavy chain consisting of (i) the amino acid sequence of the VH of P1-068761_E32Y_E56N and (ii) the amino acid sequence of SEQ ID NO: 184, and a light chain consisting of the light chain amino acid sequence of P1-068761_E32Y_E56N;

(xx) a heavy chain consisting of (i) the amino acid sequence of the VH of P1-068761_E30D_E32Y and (ii) the amino acid sequence of SEQ ID NO: 184, and a light chain consisting of the light chain amino acid sequence of P1-068761_E30D_E32Y;

(yy) a heavy chain consisting of (i) the amino acid sequence of the VH of P1-068761_E32Y_H100G and (ii) the amino acid sequence of SEQ ID NO: 184, and a light chain consisting of the light chain amino acid sequence of P1-068761_E32Y_H100G;

(zz) a heavy chain consisting of (i) the amino acid sequence of the VH of P1-068761_E32Y_E100fF and (ii) the amino acid sequence of SEQ ID NO: 184, and a light chain consisting of the light chain amino acid sequence of P1-068761_E32Y_E100fF;

(aaa) a heavy chain consisting of (i) the amino acid sequence of the VH of P1-068767_D52N_D102V and (ii) the amino acid sequence of SEQ ID NO: 184, and a light chain consisting of the light chain amino acid sequence of P1-068767_D52N_D102V;

(bbb) a heavy chain consisting of (i) the amino acid sequence of the VH of P1-068767_D52N and (ii) the amino acid sequence of SEQ ID NO: 184, and a light chain consisting of the light chain amino acid sequence of P1-068767_D52N;

(ccc) a heavy chain consisting of (i) the amino acid sequence of the VH of P1-068767_D52N_E55A and (ii) the amino acid sequence of SEQ ID NO: 184, and a light chain consisting of the light chain amino acid sequence of P1-068767_D52N_E55A;

(ddd) a heavy chain consisting of (i) the amino acid sequence of the VH of P1-068767_E55A_D102V and (ii) the amino acid sequence of SEQ ID NO: 184, and a light chain consisting of the light chain amino acid sequence of P1-068767_E55A_D102V;

(eee) a heavy chain consisting of (i) the amino acid sequence of the VH of P1-068767_D102V and (ii) the amino acid sequence of SEQ ID NO: 184, and a light chain consisting of the light chain amino acid sequence of P1-068767_D102V;

(fff a heavy chain consisting of (i) the amino acid sequence of the VH of P1-068767_E55A and (ii) the amino acid sequence of SEQ ID NO: 184, and a light chain consisting of the light chain amino acid sequence of P1-068767_E55A;

(ggg) a heavy chain consisting of (i) the amino acid sequence of the VH of P1-068767_E30D_D52N and (ii) the amino acid sequence of SEQ ID NO: 184, and a light chain consisting of the light chain amino acid sequence of P1-068767_E30D_D52N;

(hhh) a heavy chain consisting of (i) the amino acid sequence of the VH of P1-068767_E30D_D102V and (ii) the amino acid sequence of SEQ ID NO: 184, and a light chain consisting of the light chain amino acid sequence of P1-068767_E30D_D102V;

(iii) a heavy chain consisting of (i) the amino acid sequence of the VH of P1-068767_E30D and (ii) the amino acid sequence of SEQ ID NO: 184, and a light chain consisting of the light chain amino acid sequence of P1-068767_E30D;

(jjj) a heavy chain consisting of (i) the amino acid sequence of the VH of P1-068767_E30D_E55A and (ii) the amino acid sequence of SEQ ID NO: 184, and a light chain consisting of the light chain amino acid sequence of P1-068767_E30D_E55A;

(kkk) a heavy chain consisting of (i) the amino acid sequence of the VH of P1-068767_E100fF_D102V and (ii) the amino acid sequence of SEQ ID NO: 184, and a light chain consisting of the light chain amino acid sequence of P1-068767_E100fF_D102V;

(lll) a heavy chain consisting of (i) the amino acid sequence of the VH of P1-068767_E55A_E100fF and (ii) the amino acid sequence of SEQ ID NO: 184, and a light chain consisting of the light chain amino acid sequence of P1-068767_E55A_E100fF;

(mmm) a heavy chain consisting of (i) the amino acid sequence of the VH of P1-068767 D52N_E100fF and (ii) the amino acid sequence of SEQ ID NO: 184, and a light chain consisting of the light chain amino acid sequence of P1-068767_D52N_E100fF;

(nnn) a heavy chain consisting of (i) the amino acid sequence of the VH of P1-068767_E100fF and (ii) the amino acid sequence of SEQ ID NO: 184, and a light chain consisting of the light chain amino acid sequence of P1-068767_E100fF;

(ooo) a heavy chain consisting of (i) the amino acid sequence of the VH of P1-068767_E30D_E100fF and (ii) the amino acid sequence of SEQ ID NO: 184, and a light chain consisting of the light chain amino acid sequence of P1-068767 E30D_E100fF;

(ppp) a heavy chain consisting of (i) the amino acid sequence of the VH of P1-061029_F100fE_V102D and (ii) the amino acid sequence of SEQ ID NO: 184, and a light chain consisting of the light chain amino acid sequence of P1-061029_F100fE_V102D;

(qqq) a heavy chain consisting of (i) the amino acid sequence of the VH of P1-061029° F.100fE and (ii) the amino acid sequence of SEQ ID NO: 184, and a light chain consisting of the light chain amino acid sequence of P1-061029_F100fE;

(rrr) a heavy chain consisting of (i) the amino acid sequence of the VH of P1-061029_V102D and (ii) the amino acid sequence of SEQ ID NO: 184, and a light chain consisting of the light chain amino acid sequence of P1-061029_V102D;

(sss) a heavy chain consisting of (i) the amino acid sequence of the VH of P1-061029_Y32E and (ii) the amino acid sequence of SEQ ID NO: 184, and a light chain consisting of the light chain amino acid sequence of P1-061029_Y32E; or (ttt) a heavy chain consisting of (i) the amino acid sequence of the VH of P1-061029_Y32E_F1001E and (ii) the amino acid sequence of SEQ ID NO: 184, and a light chain consisting of the light chain amino acid sequence of P1-061029_Y32E_F100fE.

wherein the C-terminal amino acid of VH and the N-terminal amino acid of SEQ ID NO: 184 form a peptidic bond; and optionally wherein the VH in any of (a) to (ttt) comprises one or both of the K16R and T84A substitutions.

In some embodiments, the disclosure contemplates anti-VISTA mAbs comprising:

a heavy chain consisting of the amino acid sequences of (i) a VH of (a) to (ttt) listed above, (ii) SEQ ID NO: 184, and (iii) a Lys residue, wherein the C-terminal amino acid of VH and the N-terminal amino acid of SEQ ID NO: 184 form a peptidic bond and wherein the C-terminal amino acid of SEQ ID NO: 184 is joined to the N-terminal of the Lys; and a light chain consisting of the light chain amino acid sequence of (a) to (ttt) listed above;

wherein the VH and light chain amino acid sequences are chosen from the same antibody species from among (a) to (ttt) listed above.

In some embodiments, an anti-hVISTA Ab may comprise an amino acid VH sequence that is at least 90%, at least 91%, at least 92%, at least 93%, at least 94%, at least 95%, at least 96%, at least 97%, at least 98%, or at least 99% identical to that of P1-061029, wherein the antibody comprises a VH CDR1, CDR2, and/or CDR3 of P1-061029 in which at least one residue has been substituted with a D, an E, or an H. In some embodiments, each of the VH CDR1, CDR2, and CDR3 of P1-061029 contains one, two, or three residues substituted with a D, E, or H. In some embodiments, an anti-hVISTA Ab may comprise an amino acid VH sequence that is at least 90%, at least 91%, at least 92%, at least 93%, at least 94%, at least 95%, at least 96%, at least 97%, at least 98%, or at least 99% identical to that of P1-061029, wherein the antibody comprises a VH CDR1 comprising one or two D or E residues at amino acid positions 4, 5, or 7 of CDR1, and/or comprises a VH CDR2 with one, two, or three D, E, or H residues at positions 3, 5, 6, or 7 of CDR2, and/or a VH CDR3 with one, two, or three D, E, or H residues at positions 6, 12, or 14 of CDR 3. (See Table 5 below for examples os antibodies falling within these embodiments.) In such cases, the light chain variable region may comprise the CDR1, CDR2, and/or CDR3 of P1-061029 or P1-061015 or progeny thereof, such as P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075, P1-069077, P1-061015, P1-068736, P1-068738, P1-068740, P1-068742, P1-068744, P1-068766, P1-068748, P1-068750, P1-068752 P1-068754, P1-068761_E55A, P1-068761_H100G, P1-068761_E56N, P1-068761_E55A_E56N, P1-068761_E30D, P1-068761_E30D_E55A, P1-068761_E56N_H100G, P1-068761-E30D_H100G, P1-068761_E30D_E56N, P1-068761_E100fF, P1-068761E55A_E100fF, P1-068761_H100G_E100fF, P1-068761_E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, P1-068761_E32Y_E100fF, P1-068767_D52N_D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767_E100fF, P1-068767_E30D_E100fF, P1-061029_F100fE_V102D, P1-061029_F100fE, P1-061029_V102D, P1-061029_Y32E, or P1-061029_Y32E_F100fE, and/or the light chain variable region may be at least 90%, at least 91%, at least 92%, at least 93%, at least 94%, at least 95%, at least 96%, at least 97%, at least 98%, or at least 99% identical to that of P1-061029 or P1-061015 or progeny thereof, such as P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075, P1-069077, P1-061015, P1-068736, P1-068738, P1-068740, P1-068742, P1-068744, P1-068766, P1-068748, P1-068750, P1-068752 P1-068754, P1-068761_E55A, P1-068761_H100G, P1-068761_E56N, P1-068761_E55A_E56N, P1-068761_E30D, P1-068761_E30D_E55A, P1-068761_E56N_H100G, P1-068761_E30D_H100G, P1-068761_E30D_E56N, P1-068761_E100fF, P1-068761_E55A_E100fF, P1-068761_H100G_E100fF, P1-068761_E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, P1-068761_E32Y_E100fF, P1-068767_D52N_D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767 E100fF, P1-068767 E30D_E100fF, P1-061029_F100fE_V102D, P1-061029_F100fE, P1-061029_V102D, P1-061029_Y32E, or P1-061029_Y32E_F100fE.

In some embodiments, an anti-hVISTA Ab may comprise an amino acid VH sequence that is at least 90%, at least 91%, at least 92%, at least 93%, at least 94%, at least 95%, at least 96%, at least 97%, at least 98%, or at least 99% identical to that of P1-061015, wherein the antibody comprises a VH CDR1, CDR2, and/or CDR3 of P1-061015 in which at least one residue has been substituted with a D, an E, or an H. In some embodiments, each of the VH CDR1, CDR2, and CDR3 of P1-061015 contains one, two, or three residues substituted with a D, E, or H. In some embodiments, an anti-hVISTA Ab may comprise an amino acid VH sequence that is at least 90%, at least 91%, at least 92%, at least 93%, at least 94%, at least 95%, at least 96%, at least 97%, at least 98%, or at least 99% identical to that of P1-061015, wherein the antibody comprises a VH CDR1 comprising one or two D, E, or H residues at amino acid positions 6, 7, 8, and 9 of CDR1, and/or comprises a VH CDR2 with one, two, or three D, E, or H residues at positions 1, 2, 4, or 8-11 of CDR2, and/or a VH CDR3 with one, two, or three D, E, or H residues at positions 2, 3, 6, 7, or 12 of CDR 3. (See Table 6 below for examples os antibodies falling within these embodiments.) In such cases, the light chain variable region may comprise the CDR1, CDR2, and/or CDR3 of P1-061029 or P1-061015 or progeny thereof, such as P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075, P1-069077, P1-061015, P1-068736, P1-068738, P1-068740, P1-068742, P1-068744, P1-068766, P1-068748, P1-068750, P1-068752 P1-068754, P1-068761_E55A, P1-068761_H100G, P1-068761_E56N, P1-068761_E55A_E56N, P1-068761_E30D, P1-068761_E30D_E55A, P1-068761_E56N_H100G, P1-068761_E30D_H100G, P1-068761_E30D_E56N, P1-068761_E100fF, P1-068761_E55A_E100fF, P1-068761_H100G_E100fF, P1-068761_E30D_E100fF, P1-068761_E56N_E100fF, P1-068761_E32Y, P1-068761_E32Y_E55A, P1-068761_E32Y_E56N, P1-068761_E30D_E32Y, P1-068761_E32Y_H100G, P1-068761_E32Y_E100fF, P1-068767_D52N_D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767_E100fF, P1-068767_E30D_E100fF, P1-061029_F100fE_V102D, P1-061029_F100fE, P1-061029_V102D, P1-061029_Y32E, or P1-061029_Y32E_F100fE and/or the light chain variable region may be at least 90%, at least 91%, at least 92%, at least 93%, at least 94%, at least 95%, at least 96%, at least 97%, at least 98%, or at least 99% identical to that of P1-061029 or P1-061015 or progeny thereof, such as P1-061029, P1-068757, P1-068759, P1-068761, P1-068763, P1-068765, P1-068767, P1-068769, P1-068771, P1-068773, P1-068775, P1-069059, P1-069061, P1-069063, P1-069065, P1-069067, P1-069069, P1-069071, P1-069073, P1-069075, P1-069077, P1-061015, P1-068736, P1-068738, P1-068740, P1-068742, P1-068744, P1-068766, P1-068748, P1-068750, P1-068752 P1-068754, P1-068761_E55A, P1-068761_H100G, P1-068761_E56N, P1-068761_E55A_E56N, P1-068761_E30D, P1-068761_E30D_E55A, P1-068761_E56N_H100G, P1-068761_E30D_H100G, P1-068761_E30D_E56N, P1-068761_E100fF, P1-068761_E55A_E100fF, P1-068761_H100G_E100fF, P1-068761_E30D_E100fF, P1-068761_E56N_E100fF, P1-068761_E32Y, P1-068761_E32Y_E55A, P1-068761_E32Y_E56N, P1-068761-E30D_E32Y, P1-068761_E32Y_H100G, P1-068761_E32Y_E100fF, P1-068767_D52N_D102V, P1-068767_D52N, P1-068767_D52N_E55A, P1-068767_E55A_D102V, P1-068767_D102V, P1-068767_E55A, P1-068767_E30D_D52N, P1-068767_E30D_D102V, P1-068767_E30D, P1-068767_E30D_E55A, P1-068767_E100fF_D102V, P1-068767_E55A_E100fF, P1-068767_D52N_E100fF, P1-068767_E100fF, P1-068767_E30D_E100fF, P1-061029_F100fE_V102D, P1-061029_F100fE, P1-061029_V102D, P1-061029_Y32E, or P1-061029_Y32E_F100fE.

In some embodiments, such modified anti-hVISTA P1-061029 or P1-061015 progeny possess one or more of the following characteristics:

- specifically binding to hVISTA, e.g., histidine rich region of the ECD or a polypeptide comprising amino acid residues 35-127 of SEQ ID NO: 2, at acidic pH, e.g., pH 6.0 or pH 6.5;
- lacking of significant binding to hVISTA, e.g., histidine rich region of the ECD or a polypeptide comprising amino acid residues 35-127 of SEQ ID NO: 2, at physiological pH or neutral pH, e.g., pH 7.4 or pH 7.0;
- specifically binding to cyno VISTA, e.g., histidine rich region of the ECD, at acidic pH, e.g., pH 6.0 or pH 6.5;
- lacking of significant binding to cyno VISTA, e.g., histidine rich region of the ECD, at physiological pH or neutral pH, e.g., pH 7.4 or pH 7.0;
- having reduced binding to hVISTA-ECD having a substitution at one or more of the following amino acids: T35, Y37, K38, T39, Y41, R54, T61, F62, Q63, L65, H66, L67, H68, H69, F97, L115, V117, I119, H121, H122, S124, E125, R127 relative to hVISTA ECD having SEQ ID NO: 2;
- cross-competing for binding to hVISTA with P1-061029, P1-068761, P1-068767 and/or P1-061015;
- inhibiting binding of hVISTA to human T cells expressing VISTA (e.g., naïve or activated T cells) at acidic pH e.g., pH 6.0 or pH 6.5;
- inhibiting binding of hVISTA to PSGL-1 at acidic pH e.g., pH 6.0 or pH 6.5 (e.g., inhibiting the interaction between H153 and H154 of hVISTA having SEQ ID NO: 1 and PSGL-1 tyrosines Y46 and Y48), wherein PSGL-1 is with or without siayl lewis X, and wherein the tyrosines are preferably sulfotyrosines;
- a mean residence time (MRT) of at least 100, 200, 300, 350, 400, 450, 500, 600 or 700 hours (e.g., at least 350 hours) in cynomolgus monkeys, measured, e.g, as described in the Examples;
- stimulating T cell activation by, e.g., enhancing T cell proliferation; enhancing IFN-γ production from T cells; and/or stimulating T cell receptor mediated NF-kB signaling;
- inhibiting VISTA mediated cell: cell adhesion;
- specifically binding to hVISTA in samples of human tumor cells or samples of inflamed human tissue that express VISTA;
- contacting hVISTA through one or more (e.g., at least 1-3, 1-5, 1-10, 5-10, 5-15 or all) energetically important contact residues Y37, T39, R54, F62, H66, V 117, 1119 or S124, as determined, e.g., using the yeast surface display and NGS assay described in Example 15; and wherein numbering is that of mature hVISTA;
- binding to Region 1: $_{57}$LGPVDKGHDVTF$_{68}$; Region 2: $_{86}$RRPIRNLTFQDL$_{97}$; and Region 3: $_{148}$VVEIRHHHSEHRVHGAME$_{165}$ of hVISTA having SEQ ID NO: 1, and optionally wherein the binding is strongest to Region 2, as determined by MS-HDX as described in Example 21;
- binding to the histidine-rich β-sheet extension of hVISTA, as determined, e.g., by crystallography, as described, e.g., in the Examples;
- contacting H121, H122 and/or H123 of mature hVISTA (distance of 4.0 Ångströms (Å) or less), such as through hydrogen bonds, as determined, e.g., by crystallography, as described, e.g., in the Examples;
- contacting hVISTA through at least one or more glutamic acid, aspartic acid or histidine residue that is located in VH CDR1, CDR2 or CDR3; and
- and any additional characteristic set forth in the claims and/or in the Examples.

Exemplary Antibody Constant Regions

In some embodiments, an antibody described herein comprises one or more human constant regions. In some embodiments, the human heavy chain constant region is of an isotype selected from IgA, IgG, and IgD. In some embodiments, the human light chain constant region is of an isotype selected from κ and λ. In some embodiments, an antibody described herein comprises a human IgG constant region, such as an IgG1, IgG2, IgG3, or IgG4. In some embodiments, an antibody described herein comprises a human IgG4 heavy chain constant region. In some such embodiments, an antibody described herein comprises an S241P mutation in the human IgG4 constant region. In some embodiments, an antibody described herein comprises a human IgG4 constant region and a human κ light chain.

The choice of heavy chain constant region can determine whether or not an antibody will have effector function in vivo. Such effector function, in some embodiments, includes antibody-dependent cell-mediated cytotoxicity (ADCC) and/or complement-dependent cytotoxicity (CDC), and can result in killing of the cell to which the antibody is bound. In some methods of treatment, including methods of treating some cancers, cell killing may be desirable, for example, when the antibody binds to a cell that supports the maintenance or growth of the tumor. Exemplary cells that may support the maintenance or growth of a tumor include, but are not limited to, tumor cells themselves, cells that aid in the recruitment of vasculature to the tumor, and cells that provide ligands, growth factors, or counter-receptors that support or promote tumor growth or tumor survival. In some embodiments, when effector function is desirable, an antibody comprising a human IgG1 heavy chain or a human IgG3 heavy chain is selected.

In certain embodiments, an antibody provided herein is altered to increase or decrease the extent to which the antibody is glycosylated. Addition or deletion of glycosylation sites to an antibody may be conveniently accomplished by altering the amino acid sequence such that one or more glycosylation sites is created or removed.

Where the antibody comprises an Fc region, the carbohydrate attached thereto may be altered. Native antibodies produced by mammalian cells typically comprise a branched, biantennary oligosaccharide that is generally attached by an N-linkage to Asn297 of the CH2 domain of the Fc region. See, e.g., Wright et al. *TIBTECH* 15:26-32 (1997). The oligosaccharide may include various carbohydrates, e.g., mannose, N-acetyl glucosamine (GlcNAc), galactose, and sialic acid, as well as a fucose attached to a GlcNAc in the "stem" of the biantennary oligosaccharide structure. In some embodiments, modifications of the oligosaccharide in an antibody of the invention may be made in order to create antibodies with certain improved properties. For example, in some embodiments an antibody may be afucosylated, for example, by mutating residues such as Asn297 that are normally glycosylated with fucose-containing glycosylations, or through other means. In some embodiments, antibodies herein may comprise an afucosylated human IgG1 constant region.

Antibodies are further provided with bisected oligosaccharides, e.g., in which a biantennary oligosaccharide attached to the Fc region of the antibody is bisected by GlcNAc. Such antibodies may have reduced fucosylation and/or improved ADCC function. Examples of such antibodies are described, e.g., in WO 2003/011878 (Jean-Mairet et al.); U.S. Pat. No. 6,602,684 (Umana et al.); and US 2005/0123546 (Umana et al.). Antibodies with at least one galactose residue in the oligosaccharide attached to the Fc region are also provided. Such antibodies may have improved CDC function. Such antibodies are described, e.g., in WO 1997/30087 (Patel et al.); WO 1998/58964 (Raju, S.); and WO 1999/22764 (Raju, S.).

Antibodies are also provided with amino-terminal leader extensions. For example, one or more amino acid residues of the amino-terminal leader sequence are present at the amino-terminus of any one or more heavy or light chains of an antibody. An exemplary amino-terminal leader extension comprises, consists or consists of three amino acid residues, VHS, present on one or both light chains of an antibody.

The in vivo or serum half-life of human FcRn high affinity binding polypeptides can be assayed, e.g., in transgenic mice, in humans, or in non-human primates to which the polypeptides with a variant Fc region are administered. See also, e.g., Petkova et al. *International Immunology* 18(12): 1759-1769 (2006).

In some embodiments of the invention, an afucosylated antibody mediates ADCC in the presence of human effector cells more effectively than a parent antibody that comprises fucose, Generally, ADCC activity may be determined using the in vitro ADCC assay as herein disclosed, but other assays or methods for determining ADCC activity, e.g. in an animal model etc., are contemplated.

In certain embodiments, the Fc region is altered by replacing at least one amino acid residue with a different amino acid residue to alter the effector function(s) of the antibody. For example, one or more amino acids selected from amino acid residues 234, 235, 236, 237, 297, 318, 320, 322, 330, and/or 331 can be replaced with a different amino acid residue such that the antibody has an altered affinity for an effector ligand but retains the antigen-binding ability of the parent antibody. The effector ligand to which affinity is altered can be, for example, an Fc receptor or the C1 component of complement. This approach is described in further detail in U.S. Pat. Nos. 5,624,821 and 5,648,260, both by Winter et al.

In some examples, one or more amino acids selected from amino acid residues 329, 331 and 322 can be replaced with a different amino acid residue such that the antibody has altered C1q binding and/or reduced or abolished complement dependent cytotoxicity (CDC). This approach is described in further detail in U.S. Pat. No. 6,194,551 by Idusogie et al.

In some examples, one or more amino acid residues within amino acid positions 231 and 239 are altered to thereby alter the ability of the antibody to fix complement. This approach is described further in PCT Publication WO 94/29351 by Bodmer et al. In some examples, the Fc region can be modified to decrease antibody dependent cellular cytotoxicity (ADCC) and/or to decrease the affinity for an Fcγ receptor by modifying one or more amino acids at the following positions: 234, 235, 236, 238, 239, 240, 241, 243, 244, 245, 247, 248, 249, 252, 254, 255, 256, 258, 262, 263, 264, 265, 267, 268, 269, 270, 272, 276, 278, 280, 283, 285,286, 289, 290, 292, 293, 294, 295, 296, 298, 299, 301, 303, 305, 307, 309, 312, 313, 315, 320, 322, 324, 325, 326, 327, 329, 330, 331, 332, 333, 334, 335, 337, 338, 340, 360, 373, 376, 378, 382, 388, 389, 398, 414, 416, 419, 430, 433, 434, 435, 436, 437, 438 or 439. Exemplary substitutions include 236A, 239D, 239E, 268D, 267E, 268E, 268F, 324T, 332D, and 332E. Exemplary variants include 239D/332E, 236A/332E, 236A/239D/332E, 268F/324T, 267E/268F, 267E/324T, and 267E/268F7324T. Other Fc modifications that can be made to Fcs are those for reducing or ablating binding to FcγR and/or complement proteins, thereby reducing or ablating Fc-mediated effector functions such as ADCC, ADCP, and CDC. Exemplary modifications include but are not limited substitutions, insertions, and deletions at positions 234, 235, 236, 237, 267, 269, 325, 328, 330, and/or 331 (e.g., 330 and 331), wherein numbering is according to the EU index. Exemplary substitutions include but are not limited to 234A, 235E, 236R, 237A, 267R, 269R, 325L, 328R, 330S, and 331S (e.g., 330S, and 331 S), wherein numbering is according to the EU index. An Fc variant can comprise 236R/328R. Other modifications for reducing FcγR and complement interactions include substitutions 297A, 234A, 235A, 237A, 318A, 228P, 236E, 268Q, 309L, 330S, 331 S, 220S, 226S, 229S, 238S, 233P, and 234V, as well as removal of the glycosylation at position 297 by mutational or enzymatic means or by production in organisms such as bacteria that do not glycosylate proteins. These and other modifications are reviewed in Strohl, 2009, Current Opinion in Biotechnology 20:685-691. For example, the human IgG1.3 Fc constant region contains L234A, L235E, and G237A substitutions. The IgG1fa.P238K (or IgG1.P238K) contains a P238K substitution. The IgG1.1f omprises L234A, L235E, G237A, A330S, and P331S substitutions.

Fc variants that enhance affinity for an inhibitory receptor FcγRIIb can also be used. Such variants can provide an Fc fusion protein with immunomodulatory activities related to FcγRIIb cells, including for example B cells and monocytes. In one embodiment, the Fc variants provide selectively enhanced affinity to FcγRIIb relative to one or more activating receptors. Modifications for altering binding to FcγRIIb include one or more modifications at a position selected from the group consisting of 234, 235, 236, 237, 239, 266, 267, 268, 325, 326, 327, 328, 330, 331, and 332, according to the EU index. Exemplary substitutions for enhancing FcγRIIb affinity include but are not limited to 234A, 234D, 234E, 234F, 234W, 235D, 235E, 235F, 235R, 235Y, 236D, 236N, 237A, 237D, 237N, 239D, 239E, 266M, 267D, 267E, 268D, 268E, 327D, 327E, 328F, 328W, 328Y, 330S, 331S, and 332E. Exemplary substitutions include 235Y, 236D, 239D, 266M, 267E, 268D, 268E, 328F, 328W, and 328Y. Other Fc variants for enhancing binding to FcγRIIb include 235Y/267E, 236D/267E, 239D/268D, 239D/267E, 267E/268D, 267E/268E, and 267E/328F.

Other modifications for enhancing FcγR and complement interactions include but are not limited to substitutions 298 A, 333A, 334A, 326A, 247I, 339D, 339Q, 280H, 290S, 298D, 298V, 243L, 292P, 300L, 396L, 305I, and 396L. These and other modifications are reviewed in Strohl, 2009, Current Opinion in Biotechnology 20:685-691. Fc modifications that increase binding to an Fcγ receptor include amino acid modifications at any one or more of amino acid positions 238, 239, 248, 249, 252, 254, 255, 256, 258, 265, 267, 268, 269, 270, 272, 279, 280, 283, 285, 298, 289, 290, 292, 293, 294, 295, 296, 298, 301, 303, 305, 307, 312, 315, 324, 327, 329, 330, 335, 337, 338, 340, 360, 373, 376, 379, 382, 388, 389, 398, 414, 416, 419, 430, 434, 435, 437, 438 or 439 of the Fc region, wherein the numbering of the residues in the Fc region is that of the EU index as in Patent Publication No. WO 00/42072.

Optionally, the Fc region can comprise a non-naturally occurring amino acid residue at additional and/or alternative positions known to one skilled in the art (see, e.g., U.S. Pat. Nos. 5,624,821; 6,277,375; 6,737,056; 6,194,551; 7,317,091; 8,101,720; PCX Patent Publications WO 00/42072; WO 01/58957; WO 02/06919; WO 04/016750; WO 04/029207; WO 04/035752; WO 04/074455; WO 04/099249; WO 04/063351; WO 05/070963; WO 05/040217, WO 05/092925 and WO 06/0201 14).

The affinities and binding properties of an Fc region for its ligand can be determined by a variety of in vitro assay methods (biochemical or immunological based assays) known in the art including but not limited to, equilibrium methods (e.g., enzyme-linked immunoabsorbent assay (ELISA), or radioimmunoassay (RIA)), or kinetics (e.g., BIACORE analysis), and other methods such as indirect binding assays, competitive inhibition assays, fluorescence resonance energy transfer (FRET), gel electrophoresis and chromatography (e.g., gel filtration). These and other methods can utilize a label on one or more of the components being examined and/or employ a variety of detection methods including but not limited to chromogenic, fluorescent, luminescent, or isotopic labels. A detailed description of binding affinities and kinetics can be found in Paul, W. E., ed., Fundamental immunology, 4th Ed., Lippincott-Raven, Philadelphia (1999), which focuses on antibody-immunogen interactions.

In certain embodiments, the antibody is modified to increase its biological half-life. Various approaches are possible. For example, this can be done by increasing the binding affinity of the Fc region for FcRn, For example, one or more of more of following residues can be mutated: 252, 254, 256, 433, 435, 436, as described in U.S. Pat. No. 6,277,375. Specific exemplary substitutions include one or more of the following: T252L, T254S, and/or T256F. Alternatively, to increase the biological half life, the antibody can be altered within the CH1 or CL region to contain a salvage receptor binding epitope taken from two loops of a CH2 domain of an Fc region of an IgG, as described in U.S. Pat. Nos. 5,869,046 and 6,121,022 by Presta et al. Other exemplary variants that increase binding to FcRn and/or improve pharmacokinetic properties include substitutions at positions 259, 308, 428, and 434, including for example 259I, 308F, 428L, 428M, 434S, 4341 1. 434F, 434Y, and 434X1. Other variants that increase Fc binding to FcRn include: 250E, 250Q, 428 L, 428F, 250Q/428L (Hinton et al. 2004, J. Biol. Chem. 279(8): 6213-6216, Hinton et al. 2006 Journal of Immunology 176:346-356), 256A, 272A, 286A, 305A, 307A, 307Q, 31 IA, 312A, 376A, 378Q, 380A, 382A, 434A (Shields et al., Journal of Biological Chemistry, 2001, 276(9):6591-6604), 252F, 252T, 252Y, 252W, 254T, 256S, 256R, 256Q, 256E, 256D, 256T, 309P, 31 1 S, 433R, 433S, 4331, 433P, 433Q, 434H, 434F, 434Y, 252Y/254T/256E, 433K/434F/436H, 308T/309P/311S (Dall Acqua et al. Journal of Immunology, 2002, 169:5171-5180, Dall'Acqua et al., 2006, Journal of Biological Chemistry 281:23514-23524). Other modifications for modulating FcRn binding are described in Yeung et al., 2010, J Immunol, 182:7663-7671.

In certain embodiments, hybrid IgG isotypes with particular biological characteristics can be used. For example, an IgG1/IgG3 hybrid variant can be constructed by substituting IgG1 positions in the CH2 and/or CH3 region with the amino acids from IgG3 at positions where the two isotypes differ. Thus a hybrid variant IgG antibody can be constructed that comprises one or more substitutions, e.g., 274Q, 276K, 300F, 339T, 356E, 358M, 384S, 392N, 397M, 4221, 435R, and 436F. In some embodiments described herein, an IgG1/IgG2 hybrid variant can be constructed by substituting IgG2 positions in the CH2 and/or CH3 region with amino acids from IgG1 at positions where the two isotypes differ. Thus a hybrid variant IgG antibody can be constructed that comprises one or more substitutions, e.g., one or more of the following amino acid substitutions: 233E, 234L, 235L, -236G (referring to an insertion of a glycine at position 236), and 327A.

Moreover, the binding sites on human IgG1 for FcγRI, FcγRII, FcγRIII and FcRn have been mapped and variants with improved binding have been described (see Shields, R. L. et al. (2001) J. Biol. Chem. 276:6591-6604). Specific mutations at positions 256, 290, 298, 333, 334 and 339 were shown to improve binding to FcγRIII. Additionally, the following combination mutants were shown to improve FcγRIII binding: T256A/S298A, S298A/E333A, S298A/K224A and S298A/E333A/K334A, which has been shown to exhibit enhanced FcγRIIIa binding and ADCC activity (Shields et al., 2001). Other IgG1 variants with strongly enhanced binding to FcγRIIIa have been identified, including variants with S239D/I332E and S239D/I332E/A330L mutations which showed the greatest increase in affinity for FcγRIIIa, a decrease in FcγRIIb binding, and strong cytotoxic activity in cynomolgus monkeys (Lazar et al., 2006). Introduction of the triple mutations into antibodies such as alemtuzumab (CD52-specific), trastuzumab (HER2/neu-specific), rituximab (CD20-specific), and cetuximab (EGFR-specific) translated into greatly enhanced ADCC activity in vitro, and the S239D/I332E variant showed an enhanced capacity to deplete B cells in monkeys (Lazar et al., 2006). In addition, IgG1 mutants containing L235V, F243L, R292P, Y300L and P396L mutations which exhibited enhanced binding to FcγRIIIa and concomitantly enhanced ADCC activity in transgenic mice expressing human FcγRIIIa in models of B cell malignancies and breast cancer have been identified (Stavenhagen et al., 2007; Nordstrom et al., 2011). Other Fc mutants that can be used include: S298A/E333A/L334A, S239D/I332E, S239D/I332E/A330L, L235V/F243L/R292P/Y300L/P396L, and M428L/N434S.

In certain embodiments, an Fc is chosen that has reduced binding to FcγRs. An exemplary Fc, e.g., IgG1 Fc, with reduced FcγR binding comprises the following three amino acid substitutions: L234A, L235E and G237A.

In certain embodiments, an Fc is chosen that has reduced complement fixation. An exemplary Fc, e.g., IgG1 Fc, with reduced complement fixation has the following two amino acid substitutions: A330S and P331S.

In certain embodiments, an Fc is chosen that has essentially no effector function, i.e., it has reduced binding to FcγRs and reduced complement fixation. An exemplary Fc, e.g., IgG1 Fc, that is effectorless comprises the following five mutations: L234A, L235E, G237A, A330S and P331S.

When using an IgG4 constant domain, it can include the substitution S228P, which mimics the hinge sequence in IgG1 and thereby stabilizes IgG4 molecules.

Fc modifications described in WO 2017/087678 or WO2016081746 may also be used.

In certain embodiments, the glycosylation of an antibody is modified. For example, an aglycoslated antibody can be made (i.e., the antibody lacks glycosylation). Glycosylation can be altered to, for example, increase the affinity of the antibody for antigen. Such carbohydrate modifications can be accomplished by, for example, altering one or more sites of glycosylation within the antibody sequence. For example, one or more amino acid substitutions can be made that result in elimination of one or more variable region framework glycosylation sites to thereby eliminate glycosylation at that site. Such aglycosylation can increase the affinity of the antibody for antigen. Such an approach is described in further detail in U.S. Pat. Nos. 5,714,350 and 6,350,861 by Co et al.

Glycosylation of the constant region on N297 can be prevented by mutating the N297 residue to another residue, e.g., N297A, and/or by mutating an adjacent amino acid, e.g., 298 to thereby reduce glycosylation on N297.

Additionally or alternatively, an antibody can be made that has an altered type of glycosylation, such as a hypofucosylated antibody having reduced amounts of fucosyl residues or an antibody having increased bisecting GlcNac structures. Such altered glycosylation patterns have been demonstrated to increase the ADCC ability of antibodies. Such carbohydrate modifications can be accomplished by, for example, expressing the antibody in a host cell with altered glycosylation machinery. Cells with altered glycosylation machinery have been described in the art and can be used as host cells in which to express recombinant antibodies described herein to thereby produce an antibody with altered glycosylation. For example, EP 1,176,195 by Hanai et al. describes a cell line with a functionally disrupted FUT8 gene, which encodes a fucosyl transferase, such that antibodies expressed in such a cell line exhibit hypofucosylation. PCT Publication WO 03/035835 by Presta describes a variant CHO cell line, Led 3 cells, with reduced ability to attach fucose to Asn(297)-linked carbohydrates, also resulting in hypofucosylation of antibodies expressed in that host cell (see also Shields, R. L. et al. (2002) *J. Biol. Chem.* 277:26733-26740). PCT Publication WO 99/54342 by Umana et al. describes cell lines engineered to express glycoprotein-modifying glycosyl transferases {e.g., beta(1,4)-N-acetylglucosaminyltransferase III (GnTIII)) such that antibodies expressed in the engineered cell lines exhibit increased bisecting GlcNac structures which results in increased ADCC activity of the antibodies (see also Umana et al. (1999) Nat. Biotech. 17: 176-180).

Another modification of the antibodies described herein is pegylation. An antibody can be pegylated to, for example, increase the biological (e.g., serum) half-life of the antibody. To pegylate an antibody, the antibody, or fragment thereof, typically is reacted with polyethylene glycol (PEG), such as a reactive ester or aldehyde derivative of PEG, under conditions in which one or more PEG groups become attached to the antibody or antibody fragment. In some embodiments, the pegylation is carried out via an acylation reaction or an alkylation reaction with a reactive PEG molecule (or an analogous reactive water-soluble polymer). As used herein, the term "polyethylene glycol" is intended to encompass any of the forms of PEG that have been used to derivatize other proteins, such as mono (CI-CIO) alkoxy- or aryloxy-polyethylene glycol or polyethylene glycol-maleimide. In certain embodiments, the antibody to be pegylated is an aglycosylated antibody. Methods for pegylating proteins are known in the art and can be applied to the antibodies described herein. See for example, EP 0 154 316 by Nishimura et al. and EP 0 401 384 by Ishikawa et al.

In various embodiments, an antibody binding to VISTA described herein is modified to selectively block antigen binding in tissues and environments where antigen binding would be detrimental, but allow antigen binding where it would be beneficial ("activatable antibody"). In one embodiment, a blocking peptide "mask" is generated that specifically binds to the antigen binding surface of the antibody and interferes with antigen binding, which mask is linked to each of the binding arms of the antibody by a peptidase cleavable linker. See, e.g., U.S. Pat. No. 8,518,404 to CytomX. Such constructs are useful for treatment of cancers in which protease levels are greatly increased in the tumor microenvironment compared with non-tumor tissues. Selective cleavage of the cleavable linker in the tumor microenvironment allows disassociation of the masking/blocking peptide, enabling antigen binding selectively in the tumor, rather than in peripheral tissues in which antigen binding might cause unwanted side effects. Examples of blocking peptides linked to antibodies are provided in WO 2018/08555.

Alternatively, in a related embodiment, a bivalent binding compound ("masking ligand") comprising two antigen binding domains is developed that binds to both antigen binding surfaces of the (bivalent) antibody and interfere with antigen binding, in which the two binding domains masks are linked to each other (but not the antibody) by a cleavable linker, for example cleavable by a peptidase. See, e.g., Int'l Pat. App. Pub. No. WO 2010/077643 to Tegopharm Corp. Masking ligands may comprise, or be derived from, the antigen to which the antibody is intended to bind, or may be independently generated. Such masking ligands are useful for treatment of cancers in which protease levels are greatly increased in the tumor microenvironment compared with non-tumor tissues. Selective cleavage of the cleavable linker in the tumor microenvironment allows disassociation of the two binding domains from each other, reducing the avidity for the antigen-binding surfaces of the antibody. The resulting dissociation of the masking ligand from the antibody enables antigen binding selectively in the tumor, rather than in peripheral tissues in which antigen binding might cause unwanted side effects.

Nucleic Acids and Host Cells

Also provided are nucleic acids encoding an antibody or a heavy or light chain thereof or a portion thereof. Exemplary nucleic acids are provided in the Sequence Table. Any nucleic acid that is at least 80%, 85%, 90%, 95%, 97%, 98% or 99% to a nucleic acid in the Sequence Table is encompassed herein. Compositions comprising nucleic acids encoding an antibody provided herein are also encompassed, as are cells comprising these and methods for preparing antibodies, comprising culturing a cell transformed with a nucleic acid encoding an anti-VISTA antibody, and isolating the antibody from the medium or the cell.

Methods of Treatment Using VISTA-ECD Binding Abs and Related Pharmaceutical Compositions In certain embodiments, an anti-VISTA antibody that binds to VISTA at low pH and, e.g., lacks significant binding at neutral or physiological pH, can be a VISTA antagonist antibody, i.e., an antibody that inhibits the action of VISTA, such that an immune response is stimulated. Such antibodies may be used for treating diseases in which stimulating the immune system or an immune response is desired, such as proliferative diseases (benign or malignant), cancer, and infectious diseases (e.g., viral infections).

In certain embodiments, an anti-VISTA antibody that binds to VISTA at low pH and, e.g., lacks significant binding at neutral or physiological pH can be a VISTA agonist antibody, i.e., an antibody that increases the action of VISTA, such that an immune response is inhibited. Such antibodies may be used for treating diseases in which inhibition of the immune system or an immune response is desired, such as autoimmune diseases and inflammatory conditions, such as rheumatoid arthritis, systemic lupus erythematosus, celiac disease, Sjoigren's syndrome, Grave's disease, inflammatory bowel disease, psoriasis, ankylosing spondylitis, graft versus host disease, allergy, and asthma.

The antibodies described herein may be used, for example, for treating cancer. In some embodiments, methods for treating cancer are provided, comprising administering an effective amount of an antibody described herein to a patient. In some embodiments, the Abs may trigger or enhance an immune response in the patient, such as an antigen-specific immune response. In some embodiments, the Abs may stimulate T cell activity. In some embodiments, the Abs may inhibit the growth of at least one tumor in the patient.

Provided herein are methods for treating a subject having cancer, comprising administering to the subject a therapeutically effective amount of an anti-VISTA antibody described herein, such that the subject is treated. An anti-VISTA antibody can be used alone. Alternatively, an anti-VISTA antibody can be used in conjunction with another agent, as described further below.

Examples of cancers that may be treated with an Ab specifically binding to a VISTA-ECD protein under acidic conditions as described herein include but are not limited to, carcinoma, lymphoma, blastoma, sarcoma, and leukemia. Cancers that may be treated with an Ab described herein also include cancers typically responsive to immunotherapy and those that are not typically responsive to immunotherapy. Cancers that can be treated also include VISTA positive cancers, e.g., cancers having VISTA positive tumor infiltrating cells, e.g., lymphocytes, myeloid or monocytic cells. Cancers can be cancers with solid tumors or blood malignancies (liquid tumors).

Non-limiting examples of cancers for treatment include squamous cell carcinoma, small-cell lung cancer, non-small cell lung cancer, squamous non-small cell lung cancer (NSCLC), nonsquamous NSCLC, glioma, gastrointestinal cancer, renal cancer (e.g., clear cell carcinoma), ovarian cancer, liver cancer, colorectal cancer, endometrial cancer, kidney cancer (e.g., renal cell carcinoma (RCC)), prostate cancer (e.g., hormone refractory prostate adenocarcinoma), thyroid cancer, neuroblastoma, pancreatic cancer, glioblastoma (glioblastoma multiforme), cervical cancer, stomach cancer, bladder cancer, hepatoma, breast cancer, colon carcinoma, and head and neck cancer (or carcinoma), gastric cancer, germ cell tumor, pediatric sarcoma, sinonasal natural killer, melanoma (e.g., metastatic malignant melanoma, such as cutaneous or intraocular malignant melanoma), bone cancer, skin cancer, uterine cancer, cancer of the anal region, testicular cancer, carcinoma of the fallopian tubes, carcinoma of the endometrium, carcinoma of the cervix, carcinoma of the vagina, carcinoma of the vulva, cancer of the esophagus, cancer of the small intestine, cancer of the endocrine system, cancer of the parathyroid gland, cancer of the adrenal gland, sarcoma of soft tissue, cancer of the urethra, cancer of the penis, solid tumors of childhood, cancer of the ureter, carcinoma of the renal pelvis, neoplasm of the central nervous system (CNS), primary CNS lymphoma, tumor angiogenesis, spinal axis tumor, brain cancer, brain stem glioma, pituitary adenoma, Kaposi's sarcoma, epidermoid cancer, squamous cell cancer, T-cell lymphoma, environmentally-induced cancers including those induced by asbestos, virus-related cancers or cancers of viral origin (e.g., human papilloma virus (HPV-related or -originating tumors)), and hematologic malignancies derived from either of the two major blood cell lineages, i.e., the myeloid cell line (which produces granulocytes, erythrocytes, thrombocytes, macrophages and mast cells) or lymphoid cell line (which produces B, T, NK and plasma cells), such as all types of leukemias, lymphomas, and myelomas, e.g., acute, chronic, lymphocytic and/or myelogenous leukemias, such as acute leukemia (ALL), acute myelogenous leukemia (AML), chronic lymphocytic leukemia (CLL), and chronic myelogenous leukemia (CML), undifferentiated AML (MO), myeloblastic leukemia (M1), myeloblastic leukemia (M2; with cell maturation), promyelocytic leukemia (M3 or M3 variant [M3V]), myelomonocytic leukemia (M4 or M4 variant with eosinophilia [M4E]), monocytic leukemia (M5), erythroleukemia (M6), megakaryoblastic leukemia (M7), isolated granulocytic sarcoma, and chloroma; lymphomas, such as Hodgkin's lymphoma (HL), non-Hodgkin's lymphoma (NHL), B cell hematologic malignancy, e.g., B-cell lymphomas, T-cell lymphomas, lymphoplasmacytoid lymphoma, monocytoid B-cell lymphoma, mucosa-associated lymphoid tissue (MALT) lymphoma, anaplastic (e.g., Ki 1+) large-cell lymphoma, adult T-cell lymphoma/leukemia, mantle cell lymphoma, angio immunoblastic T-cell lymphoma, angiocentric lymphoma, intestinal T-cell lymphoma, primary mediastinal B-cell lymphoma, precursor T-lymphoblastic lymphoma, T-lymphoblastic; and lymphoma/leukaemia (T-Lbly/T-ALL), peripheral T-cell lymphoma, lymphoblastic lymphoma, post-transplantation lymphoproliferative disorder, true histiocytic lymphoma, primary central nervous system lymphoma, primary effusion lymphoma, B cell lymphoma, lymphoblastic lymphoma (LBL), hematopoietic tumors of lymphoid lineage, acute lymphoblastic leukemia, diffuse large B-cell lymphoma, Burkitt's lymphoma, follicular lymphoma, diffuse histiocytic lymphoma (DHL), immunoblastic large cell lymphoma, precursor B-lymphoblastic lymphoma, cutaneous T-cell lymphoma (CTLC) (also called mycosis fungoides or Sezary syndrome), and lymphoplasmacytoid lymphoma (LPL) with Waldenstrom's macroglobulinemia; myelomas, such as IgG myeloma, light chain myeloma, nonsecretory myeloma, smoldering myeloma (also called indolent myeloma), solitary plasmocytoma, and multiple myelomas, chronic lymphocytic leukemia (CLL), hairy cell lymphoma; hematopoietic tumors of myeloid lineage, tumors of mesenchymal origin, including fibrosarcoma and rhabdomyoscarcoma; seminoma, teratocarcinoma, tumors of the central and peripheral nervous, including astrocytoma, schwannomas; tumors of mesenchymal origin, including fibrosarcoma, rhabdomyoscaroma, and osteosarcoma; and other tumors, including melanoma, xeroderma pigmentosum, keratoacanthoma, seminoma, thyroid follicular cancer and teratocarcinoma, hematopoietic tumors of lymphoid lineage, for example T-cell and B-cell tumors, including but not limited to T-cell disorders such as T-prolymphocytic leukemia (T-PLL), including of the small cell and cerebriform cell type; large granular lymphocyte leukemia (LGL) of the T-cell type; a/d T-NHL hepatosplenic lymphoma; peripheral/post-thymic T cell lymphoma (pleomorphic and immunoblastic subtypes); angiocentric (nasal) T-cell lymphoma; cancer of the head or neck, renal cancer, rectal cancer, cancer of the thyroid gland; acute myeloid lymphoma, as well as any combinations of said cancers. The methods described herein can also be used for treatment of metastatic cancers, unresectable, refractory cancers (e.g., cancers refractory to previous immunotherapy, e.g., with a blocking CTLA-4 or PD-1 antibody), and/or recurrent cancers.

In some embodiments, methods of treating cancer are provided, wherein the methods comprise administering an isolated antibody that binds specifically to huVISTA in acidic conditions as described herein to a subject with cancer. In some embodiments, use of an antibody described herein for treating cancer is provided.

In certain embodiments, an antibody described herein is administered to patients having a cancer that has exhibited an inadequate response to, or progressed on, a prior treatment, e.g., a prior treatment with an immuno-oncology or immunotherapy drug. In some embodiments, the cancer is refractory or resistant to a prior treatment, either intrinsically refractory or resistant (e.g., refractory to a PD-1 pathway antagonist), or a resistance or refractory state is acquired. For example, an antibody described herein may be administered to subjects who are not responsive or not sufficiently responsive to a first therapy or who have disease progression following treatment, e.g., anti-PD-1 pathway antagonist treatment, either alone or in combination with another therapy (e.g., with an anti-PD-1 pathway antagonist therapy). In other embodiments, an antibody described herein is administered to patients who have not previously received (i.e., been treated with) an immuno-oncology agent, e.g., a PD-1 pathway antagonist.

In certain embodiments, a method of treating cancer in a subject comprises first determining the tumor mutational burden (TMB) of a tumor in a subject, and administering an anti-VISTA antibody based on the results, e.g., to subjects found to have a high TMB.

Combinations with Immune Stimulating Agents

In some embodiments, an antibody as described herein, e.g., an antagonist VISTA antibody described herein, is administered in combination with and at least one immune stimulating agent. For example, the therapeutics may be infused together or injected at roughly the same time. In some embodiments, the antibody and the at least one immune stimulating agent are administered sequentially. For example, in some embodiments the antibody is administered sequentially before or after at least one immune stimulating agent such that the two therapeutics are administered 30 minutes, 60 minutes, 90 minutes, 120 minutes, 3 hours, 6 hours, 12 hours, 24 hours, 36 hours, 48 hours, 3 days, 5 days, 7 days, or two weeks apart.

In some embodiments, at least one, at least two, at least three doses, at least five doses, or at least ten doses of the antibody is administered prior to administration of at least one immune stimulating agent. In some embodiments, at least one, at least two, at least three doses, at least five doses, or at least ten doses of at least one immune stimulating agent is administered prior to administration of the antibody. In some embodiments, the last dose of immune stimulating agent is administered at least one, two, three, five, days or ten, or one, two, three, five, twelve, or twenty four weeks prior to the first dose of the antibody. In some embodiments, the last dose of the antibody is administered at least one, two, three, five, days or ten, or one, two, three, five, twelve, or twenty four weeks prior to the first dose of at least one immune stimulating agent. In some embodiments, a subject has received, or is receiving, therapy with at least one immune stimulating agent and a VISTA-ECD-binding antibody is added to the therapeutic regimen.

In some embodiments, the at least one immune stimulating agent comprises an antagonist of an inhibitor of the activation of T cells, while in some embodiments, the at least one immune stimulating agent comprises an agonist of a stimulator of the activation of T cells. In some embodiments, the at least one immune stimulating agent comprises an antagonist of CTLA4, LAG-3, PD-1, PD-L1, Galectin 1, Galectin 9, CEACAM-1, BTLA, CD25, CD69, TIGIT, CD113, GPR56, VISTA, B7-H3, B7-H4, 2B4, CD48, GARP, PD1H, LAIR1, TIM1, TIM3, TIM4, ILT4, IL-6, IL-10, TGFβ, VEGF, KIR, LAG-3, adenosine A2A receptor, PI3Kdelta, or IDO. In some embodiments, the at least one immune stimulating agent comprises an agonist of B7-1, B7-2, CD28, 4-1BB (CD137), 4-1BBL, ICOS, ICOS-L, OX40, OX40L, GITR, GITRL, CD27, CD40, CD40L, DR3, CD28H, IL-2, IL-7, IL-12, IL-15, IL-21, IFNα, STING, or a Toll-like receptor agonist such as a TLR2/4 agonist. In some embodiments, the at least one immune stimulating agent comprises an agent that binds to another member of the B7 family of membrane-bound proteins such as B7-1, B7-2, B7-H2 (ICOS-L), B7-H3, B7-H4, and B7-H6. In some embodiments, the at least one immune stimulating agent comprises an agent that binds to a member of the TNF receptor family or a co-stimulatory or co-inhibitory molecule binding to a member of the TNF receptor family such as CD40, CD40L, OX40, OX40L, GITR, GITRL, CD70, CD27L, CD30, CD30L, 4-1BBL, CD137 (4-1BB), TRAIL/Apo2-L, TRAILR1/DR4, TRAILR2/DR5, TRAILR3, TRAILR4, OPG, RANK, RANKL, TWEAKR/Fn14, TWEAK, BAFFR, EDAR, XEDAR, EDA1, EDA2, TACI, APRIL, BCMA, LTβR, LIGHT, DeR3, HVEM, VEGL/TL1A, TRAMP/DR3, TNFR1, TNFβ, TNFR2, TNFα, 1P2, FAS, FASL, RELT, DR6, TROY, or NGFβ. In some embodiments, the at least one immune stimulating agent comprises an agent that antagonizes or inhibits a cytokine that inhibits T cell activation such as IL-6, IL-10, TGFβ, VEGF. In some embodiments, the at least one immune stimulating agent comprises an agonist of a cytokine that stimulates T cell activation such as IL-2, IL-7, IL-12, IL-15, IL-21, and IFNα. In some embodiments, the at least one immune stimulating agent comprises an antagonist of a chemokine, such as CXCR2, CXCR4, CCR2, or CCR4. In some embodiments, the at least one immune stimulating agent comprises an antibody. In some embodiments, the at least one immune stimulating agent may comprise a vaccine, such as a mesothelin-targeting vaccine or attenuated listeria cancer vaccine such as CRS-207.

For example, an anti-VISTA antibody described herein could be administered with one or more of the following agents:

(1) An antagonist (inhibitor or blocking agent) of a protein that inhibits T cell activation (e.g., immune checkpoint inhibitors), such as CTLA-4, PD-1, PD-L1, PD-L2, and LAG-3, Galectin 9, CEACAM-1, BTLA, CD69, Galectin-1, TIGIT, CD113, GPR56, B7-H3, B7-H4, 2B4, CD48, GARP, PD1H, LAIR1, TIM-1,TIM-3 and TIM-4; and/or (2) An agonist of a protein that stimulates T cell activation, such as B7-1, B7-2, CD28, 4-1BB (CD137), 4-IBBL, GITR, ICOS, ICOS-L, OX40, OX40L, CD70, CD27, CD40, DR3 and CD28H.

Exemplary agents that can be combined with anti-VISTA antibodies described herein for treating cancer include: YERVOY® (ipilimumab) or Tremelimumab (to CTLA-4), galiximab (to B7.1), BMS-936558 (to PD-1), MK-3475 (to PD-1), atezolizumab (TECENTRIQ®), Avelumab, Durvalumab, PDR001 (Novartis), AMP224 (to B7DC), BMS-936559 (to B7-H1), MPDL3280A (to B7-H1), MEDI-570 (to ICOS), AMG557 (to B7H2), MGA271 (to B7H3), IMP321 (to LAG-3), BMS-663513 (to CD137), PF-05082566 (to CD137), CDX-1127 (to CD27), anti-OX40 (Providence Health Services), huMAbOX40L (to OX40L), Atacicept (to TACI), CP-870893 (to CD40), Lucatumumab (to CD40), Dacetuzumab (to CD40), Muromonab-CD3 (to CD3); anti-GITR antibodies MK4166, TRX518, Medil873, INBRX-110, LK2-145, GWN-323, GITRL-Fc, or any combination thereof.

Other molecules that can be combined with anti-VISTA antibodies for the treatment of cancer include antagonists of inhibitory receptors on NK cells or agonists of activating receptors on NK cells, for example, antagonists of KIR (e.g., lirilumab).

T cell activation may also be regulated by soluble cytokines. In some embodiments, anti-VISTA antibodies can be administered in combination with antagonists of cytokines that are intended to inhibit T cell activation or agonists of cytokines that stimulate T cell activation. For example, anti-VISTA antibodies can be used in combination with (i) antagonists (or inhibitors or blocking agents) of proteins of the IgSF family or B7 family or the TNF family that inhibit T cell activation or antagonists of cytokines that inhibit T cell activation (e.g., IL-6, IL-10, TGF-β, VEGF; "immunosuppressive cytokines") and/or (ii) agonists of stimulatory receptors of the IgSF family, B7 family or the TNF family or of cytokines that stimulate T cell activation.

Yet other agents for combination therapies include agents that inhibit or deplete macrophages or monocytes, including but not limited to CSF-1R antagonists such as CSF-1R antagonist antibodies including RG7155 (WO11/70024, WO11/107553, WO11/131407, WO13/87699, WO13/119716, WO13/132044) or FPA-008 (WO11/140249; WO13169264; WO14/036357).

Anti-VISTA antibodies can also be administered with agents that inhibit TGF-β signaling.

Additional agents that can be combined with an anti-VISTA antibody include agents that enhance tumor antigen presentation, e.g., dendritic cell vaccines, GM-CSF secreting cellular vaccines, CpG oligonucleotides, and imiquimod, or therapies that enhance the immunogenicity of tumor cells (e.g., anthracyclines).

Yet other therapies that can be combined with an anti-VISTA antibody include therapies that deplete or block Treg cells, e.g., an agent that specifically binds to CD25.

Another therapy that can be combined with an anti-VISTA antibody is a therapy that inhibits a metabolic enzyme such as indoleamine dioxigenase (IDO), dioxigenase, arginase, or nitric oxide synthetase.

Another class of agents that can be used with an anti-VISTA antibody includes agents that inhibit the formation of adenosine, e.g., CD73 inhibitors, or inhibit the adenosine A2A receptor.

Other therapies that can be combined with an anti-VISTA antibody for treating cancer include therapies that reverse/prevent T cell anergy or exhaustion and therapies that trigger an innate immune activation and/or inflammation at a tumor site.

Other therapies that can be combined with an anti-VISTA antibody for treating cancer include therapies that block IL-8, e.g., with HuMax®-IL8.

An anti-VISTA antibody can be combined with more than one immuno-oncology agent, and can be, e.g., combined with a combinatorial approach that is intended to target multiple elements of the immune pathway, such as one or more of the following: a therapy that enhances tumor antigen presentation (e.g., dendritic cell vaccine, GM-CSF secreting cellular vaccines, CpG oligonucleotides, imiquimod); a therapy that inhibits negative immune regulation e.g., by inhibiting CTLA-4 and/or PD1/PD-L1/PD-L2 pathway and/or depleting or blocking Tregs or other immune suppressing cells; a therapy that stimulates positive immune regulation, e.g., with agonists that stimulate the CD-137, OX-40, and/or CD40 or GITR pathway and/or stimulate T cell effector function; a therapy that increases systemically the frequency of anti-tumor T cells; a therapy that depletes or inhibits Tregs, such as Tregs in the tumor, e.g., using an antagonist of CD25 (e.g., daclizumab) or by ex vivo anti-CD25 bead depletion; a therapy that impacts the function of suppressor myeloid cells in the tumor; a therapy that enhances immunogenicity of tumor cells (e.g., anthracyclines); adoptive T cell or NK cell transfer including genetically modified cells, e.g., cells modified by chimeric antigen receptors (CAR-T therapy); a therapy that inhibits a metabolic enzyme such as indoleamine dioxigenase (IDO), dioxigenase, arginase, or nitric oxide synthetase; a therapy that reverses/prevents T cell anergy or exhaustion; a therapy that triggers an innate immune activation and/or inflammation at a tumor site; administration of immune stimulatory cytokines; or blocking of immuno repressive cytokines.

Anti-VISTA antibodies described herein can be used together with one or more of agonistic agents that ligate positive costimulatory receptors, blocking agents that attenuate signaling through inhibitory receptors, antagonists, and one or more agents that increase systemically the frequency of anti-tumor T cells, agents that overcome distinct immune suppressive pathways within the tumor microenvironment (e.g., block inhibitory receptor engagement (e.g., PD-L1/PD-1 interactions), deplete or inhibit Tregs (e.g., using an anti-CD25 monoclonal antibody (e.g., daclizumab) or by ex vivo anti-CD25 bead depletion), inhibit metabolic enzymes such as IDO, or reverse/prevent T cell anergy or exhaustion) and agents that trigger innate immune activation and/or inflammation at tumor sites.

In certain embodiments, an anti-VISTA antibody is administered to a subject together with a BRAF inhibitor if the subject is BRAF V600 mutation positive.

Suitable PD-1 antagonists for use in the combination therapy described herein, include, without limitation, ligands, antibodies (e.g., monoclonal antibodies and bispecific antibodies), and multivalent agents. In one embodiment, the PD-1 antagonist is a fusion protein, e.g., an Fc fusion protein, such as AMP-244. In one embodiment, the PD-1 antagonist is an anti-PD-1 or anti-PD-L1 antibody.

An exemplary anti-PD-1 antibody is nivolumab (BMS-936558) or an antibody that comprises the CDRs or variable regions of one of antibodies 17D8, 2D3, 4H1, 5C4, 7D3, 5F4 and 4A11 described in WO 2006/121168. In certain embodiments, an anti-PD-I antibody is MK-3475 (Lambrolizumab) described in WO2012/145493; AMP-514 described in WO 2012/145493; or PDR001. Further known PD-1 antibodies and other PD-1 inhibitors include those described in WO 2009/014708, WO 03/099196, WO 2009/114335, WO 2011/066389, WO 2011/161699, WO 2012/145493, U.S. Pat. Nos. 7,635,757 and 8,217,149, and U.S. Patent Publication No. 2009/0317368. Any of the anti-PD-1 antibodies disclosed in WO2013/173223 can also be used. An anti-PD-1 antibody that competes for binding with, and/or binds to the same epitope on PD-1 as, as one of these antibodies can also be used in combination treatments.

In some embodiments, the anti-PD-L1 antibody useful for the combination therapy is BMS-936559 (referred to as 12A4 in WO 2007/005874 and U.S. Pat. No. 7,943,743), or an antibody that comprises the CDRs or variable regions of 3G10, 12A4, 10A5, 5F8, 10H10, 1B12, 7H1, 11E6, 12B7 and 13G4, which are described in PCT Publication WO 07/005874 and U.S. Pat. No. 7,943,743. In certain embodiment an anti-PD-L1 antibody is MEDI4736 (also known as durvalumab and Anti-B7-H1), MPDL3280A (also known as atezolizumab and RG7446), MSB0010718C (also known as avelumab; WO2013/79174), or rHigM12B7. Any of the anti-PD-L1 antibodies disclosed in WO2013/173223, WO2011/066389, WO2012/145493, U.S. Pat. Nos. 7,635, 757 and 8,217,149 and U.S. Publication No. 2009/145493 can also be used. Anti-PD-L1 antibodies that compete with and/or bind to the same epitope as that of any of these antibodies can also be used in combination treatments.

In certain embodiments, the anti-VISTA antibody of the disclosure can be used with a CTLA-4 antagonist, e.g., an anti-CTLA-4 antibody. In one embodiment, an anti-CTLA-4 antibody is an antibody selected from the group of: YERVOY® (ipilimumab or antibody 10D1, described in PCT Publication WO 01/14424), tremelimumab (formerly ticilimumab, CP-675,206), monoclonal or an anti-CTLA-4 antibody described in any of the following publications: WO 98/42752; WO 00/37504; U.S. Pat. No. 6,207,156; Hurwitz et al. (1998) Pro. Natl. Acad. Sci. USA 95(17): 10067-10071; Camacho et al. (2004) J. Clin. Oncology 22(145): Abstract No. 2505 (antibody CP-675206); and Mokyr et al. (1998) Cancer Res. 58:5301-5304. Any of the anti-CTLA-4 antibodies disclosed in WO2013/173223 can also be used.

In some embodiments, an anti-VISTA antibody of the disclosure is used in combination with a LAG3 antagonist. Examples of anti-LAG3 antibodies include antibodies comprising the CDRs or variable regions of antibodies 25F7, 26H10, 25E3, 8B7, 11F2 or 17E5, which are described in U.S. Patent Publication No. US2011/0150892, WO10/19570 and WO2014/008218. In one embodiment, an anti-LAG-3 antibody is BMS-986016. Other art recognized anti-LAG-3 antibodies that can be used include IMP731 and IMP-321, described in US 2011/007023, WO08/132601, and WO09/44273. Anti-LAG-3 antibodies that compete with and/or bind to the same epitope as that of any of these antibodies can also be used in combination treatments.

In some embodiments, an anti-VISTA antibody of the disclosure can be administered in combination with a CD137 (4-1BB) agonist, such as an agonistic CD137 antibody. Suitable CD137 antibodies include, for example, urelumab or PF-05082566 (WO12/32433).

In some embodiments, an anti-VISTA antibody can be administered in combination with an OX40 agonist, such as an agonistic OX40 antibody. Suitable OX40 antibodies include, for example, MEDI-6383, MEDI-6469 or MOXR0916 (RG7888; WO06/029879).

In one embodiment, an anti-VISTA antibody is administered in combination with a CD40 agonist, such as an agonistic CD40 antibody. In certain embodiments, the immuno-oncology agent is a CD40 antagonist, such as an antagonistic CD40 antibody. Suitable CD40 antibodies include, for example, lucatumumab (HCD122), dacetuzumab (SGN-40), CP-870,893 or Chi Lob 7/4.

In one embodiment, an anti-VISTA antibody is administered in combination with a CD27 agonist, such as an agonistic CD27 antibody. Suitable CD27 antibodies include, for example, varlilumab (CDX-1127).

In certain embodiments, the anti-VISTA antibody is administered together with an anti-GITR antibody, e.g., an antibody having the CDR sequences of 6C8, e.g., a humanized antibody having the CDRs of 6C8, as described, e.g., in WO2006/105021; an antibody comprising the CDRs of an anti-GITR antibody described in WO2011/028683; an antibody comprising the CDRs of an anti-GITR antibody described in JP2008278814, an antibody comprising the CDRs of an anti-GITR antibody described in WO2015/031667, WO2015/187835, WO2015/184099, WO2016/054638, WO2016/057841 or WO2016/057846 or other anti-GITR antibody described or referred to herein.

In some embodiments, an anti-VISTA antibody is administered in combination with MGA271 (to 87H3) (WO11/109400).

In some embodiments, an anti-VISTA antibody is administered in combination with a KIR antagonist, such as lirilumab.

In some embodiments, an anti-VISTA antibody is administered in combination with an IDO antagonist. Suitable IDO antagonists include, for example, INCB-024360 (WO2006/122150, WO07/75598, WO08/36653, WO08/36642), indoximod, NLG-919 (WO09/73620, WO09/1156652, WO11/56652, WO12/142237) or F001287.

In some embodiments, an anti-VISTA antibody is administered in combination with a Toll-like receptor agonist, e.g., a TLR2/4 agonist (e.g., Bacillus Calmette-Guerin); a TLR7 agonist (e.g., Hiltonol or Imiquimod); a TLR7/8 agonist (e.g., Resiquimod); or a TLR9 agonist (e.g., CpG7909).

In one embodiment, an anti-VISTA is administered in combination with a TGF-β inhibitor, e.g., GC1008, LY2157299, TEW7197, or IMC-TR1.

In certain embodiments, an anti-VISTA agent, e.g., an antibody is administered with an anti-PSGL-1 antibody.

Additional Combination Therapy

The Abs herein may also be provided before, substantially contemporaneous with, or after other modes of treatment, for example, surgery, chemotherapy, radiation therapy, or the administration of a biologic, such as another therapeutic antibody. In some embodiments, the cancer has recurred or progressed following a therapy selected from surgery, chemotherapy, and radiation therapy, or a combination thereof. For example, an anti-VISTA antibody as described herein could be administered as adjunctive therapy when there is a risk that micrometastases can be present and/or in order to reduce the risk of a relapse.

For treatment of cancer, the combinations may be administered in conjunction with one or more additional anticancer agents, such as a chemotherapeutic agent, growth inhibitory agent, anti-cancer vaccine such as a gene therapy vaccine, anti-angiogenesis agent and/or anti-neoplastic composition. Nonlimiting examples of chemotherapeutic agent, growth inhibitory agent, anti-cancer vaccine, anti-angiogenesis agent and anti-neoplastic composition that can be used in combination with the antibodies of the present invention are provided herein under "Definitions."

In some embodiments, an anti-inflammatory drug may be administered with the combination, such as a steroid or a non-steroidal anti-inflammatory drug (NSAID). In cases where it is desirable to render aberrantly proliferative cells quiescent in conjunction with or prior to treatment with anti-VISTA antibodies described herein, hormones and steroids (including synthetic analogs), such as 17a-Ethinylestradiol, Diethylstilbestrol, Testosterone, Prednisone, Fluoxymesterone, Dromostanolone propionate, Testolactone, Megestrolacetate, Methylprednisolone, Methyl-testosterone, Prednisolone, Triamcinolone, Chlorotrianisene, Hydroxyprogesterone, Aminoglutethimide, Estramustine, Medroxyprogesteroneacetate, Leuprolide, Flutamide, Toremifene, ZOLADEX®, can also be administered to the patient. When employing the methods or compositions described herein, other agents used in the modulation of tumor growth or metastasis in a clinical setting, such as antimimetics, can also be administered as desired.

Antibodies described herein can also be combined with an immunogenic agent, such as cancerous cells, purified tumor antigens (including recombinant proteins, peptides, and carbohydrate molecules), cells, and cells transfected with genes encoding immune stimulating cytokines (He et al., (2004) *J. Immunol.* 173:4919-28). Non-limiting examples of tumor vaccines that can be used include peptides of melanoma antigens, such as peptides of gp100, MAGE antigens, Trp-2, MART1 and/or tyrosinase, or tumor cells transfected to express the cytokine GM-CSF (discussed further below).

In humans, some tumors have been shown to be immunogenic such as melanomas. By lowering the threshold of T cell activation via VISTA inhibition, the tumor responses in the host can be activated, allowing treatment of non-immunogenic tumors or those having limited immunogenicity.

An anti-VISTA antibody described herein, can also be combined with a vaccination protocol. Many experimental strategies for vaccination against tumors have been devised (see Rosenberg, S., 2000, Development of Cancer Vaccines, ASCO Educational Book Spring: 60-62; Logothetis, C, 2000, ASCO Educational Book Spring: 300-302; Khayat, D. 2000, ASCO Educational Book Spring: 414-428; Foon, K. 2000, ASCO Educational Book Spring: 730-738; see also Restifo, N. and Sznol, M., Cancer Vaccines, Ch. 61, pp. 3023-3043 in DeVita et al. (eds.), 1997, Cancer: Principles and Practice of Oncology, Fifth Edition). In one of these strategies, a vaccine is prepared using autologous or allogeneic tumor cells. These cellular vaccines have been shown to be most effective when the tumor cells are transduced to express GM-CSF. GM-CSF has been shown to be a potent activator of antigen presentation for tumor vaccination (Dranoff et al. (1993) *Proc. Natl. Acad. Sci U.S.A.* 90: 3539-43).

The study of gene expression and large scale gene expression patterns in various tumors has led to the definition of so called tumor specific antigens (Rosenberg, S A (1999) *Immunity* 10: 281-7). In many cases, these tumor specific antigens are differentiation antigens expressed in the tumors and in the cell from which the tumor arose, for example melanocyte antigens gp100, MAGE antigens, and Trp-2. More importantly, many of these antigens can be shown to be the targets of tumor specific T cells found in the host. VISTA inhibition can be used in conjunction with a collection of recombinant proteins and/or peptides expressed in a tumor in order to generate an immune response to these proteins. These proteins are normally viewed by the immune system as self antigens and are therefore tolerant to them. The tumor antigen can include the protein telomerase, which is required for the synthesis of telomeres of chromosomes and which is expressed in more than 85% of human cancers and in only a limited number of somatic tissues (Kim et al. (1994) *Science* 266: 2011-2013). Tumor antigen can also be "neo-antigens" expressed in cancer cells because of somatic mutations that alter protein sequence or create fusion proteins between two unrelated sequences (i.e., bcr-abl in the Philadelphia chromosome), or idiotype from B cell tumors. Other tumor vaccines can include the proteins from viruses implicated in human cancers such a Human Papilloma Viruses (HPV), Hepatitis Viruses (HBV and HCV) and Kaposi's Herpes Sarcoma Virus (KHSV). Another form of tumor specific antigen which can be used in conjunction with VISTA inhibition is purified heat shock proteins (HSP) isolated from the tumor tissue itself. These heat shock proteins contain fragments of proteins from the tumor cells and these HSPs are highly efficient at delivery to antigen presenting cells for eliciting tumor immunity (Suot & Srivastava (1995) *Science* 269: 1585-1588; Tamura et al. (1997) *Science* 278: 117-120).

Oncolytic viruses may also be used in combination with VISTA antibodies.

Dendritic cells (DC) are potent antigen presenting cells that can be used to prime antigen-specific responses. DCs can be produced ex vivo and loaded with various protein and peptide antigens as well as tumor cell extracts (Nestle et al. (1998) *Nature Medicine* 4: 328-332). DCs can also be transduced by genetic means to express these tumor antigens as well. DCs have also been fused directly to tumor cells for the purposes of immunization (Kugler et al. (2000) *Nature Medicine* 6:332-336). As a method of vaccination, DC immunization can be effectively combined with VISTA inhibition to activate more potent anti-tumor responses.

Infectious Disease Treatments

Methods described herein can also be used to treat patients that have been exposed to particular toxins or pathogens. Accordingly, this disclosure also contemplates methods of treating an infectious disease in a subject comprising administering to the subject an antibody as described herein, e.g., an antagonist VISTA antibody, such that the subject is treated for the infectious disease. Similar to its application to tumors as discussed above, antibody-mediated VISTA inhibition can be used alone, or as an adjuvant, in combination with vaccines, to stimulate the immune response to pathogens, toxins, and self-antigens. Examples of pathogens for which this therapeutic approach might be particularly useful, include pathogens for which there is currently no effective vaccine, or pathogens for which conventional vaccines are less than completely effective. These include, but are not limited to HIV, Hepatitis (A, B, & C), Influenza, Herpes, Giardia, Malaria, Leishmania, Staphylococcus aureus, Pseudomonas aeruginosa. VISTA inhibition can be useful against established infections by agents such as HIV that present altered antigens over the course of the infections.

Some examples of pathogenic viruses causing infections that may be treatable by methods described herein include HIV, hepatitis (A, B, or C), herpes virus (e.g., VZV, HSV-1, HAV-6, HSV-II, and CMV, Epstein Barr virus), adenovirus, influenza virus, flaviviruses, echovirus, rhinovirus, coxsackie virus, coronavirus, respiratory syncytial virus, mumps virus, rotavirus, measles virus, rubella virus, parvovirus, vaccinia virus, HTLV virus, dengue virus, papillomavirus, molluscum virus, poliovirus, rabies virus, JC virus and arboviral encephalitis virus.

Some examples of pathogenic bacteria causing infections that may be treatable by methods described herein include chlamydia, rickettsial bacteria, mycobacteria, staphylococci, streptococci, pneumonococci, meningococci and gonococci, klebsiella, proteus, serratia, pseudomonas, legionella, diphtheria, salmonella, bacilli, cholera, tetanus, botulism, anthrax, plague, leptospirosis, and Lymes disease bacteria.

Some examples of pathogenic fungi causing infections that may be treatable by methods described herein include Candida (albicans, krusei, glabrata, tropicalis, etc.), Cryptococcus neoformans, Aspergillus (fumigatus, niger, etc.), Genus Mucorales (mucor, absidia, rhizopus), *Sporothrix schenkii, Blastomyces dermatitidis, Paracoccidioides brasiliensis, Coccidioides immitis* and *Histoplasma capsulatum*.

Some examples of pathogenic parasites causing infections that may be treatable by methods described herein include *Entamoeba histolytica, Balantidium coli, Naegleriafowleri, Acanthamoeba* sp., *Giardia lambia, Cryptosporidium* sp., *Pneumocystis carinii, Plasmodium vivax, Babesia microti, Trypanosoma brucei, Trypanosoma cruzi, Leishmania donovani, Toxoplasma gondii*, and *Nippostrongylus brasiliensis*.

In all of the above methods, VISTA inhibition can be combined with other forms of immunotherapy, e.g., those described herein, such as cytokine treatment (e.g., interferons, GM-CSF, G-CSF, IL-2), or bispecific antibody therapy, which may provide for enhanced presentation of tumor antigens (see, e.g., Holliger (1993) *Proc. Natl. Acad. Sci. USA* 90:6444-6448; Poljak (1994) *Structure* 2: 1121-1123).

Routes of Administration and Carriers

In various embodiments, antibodies may be administered in vivo by various routes, including, but not limited to, oral, intra-arterial, parenteral, intranasal, intramuscular, intracardiac, intraventricular, intratracheal, buccal, rectal, intraperitoneal, intradermal, topical, transdermal, and intrathecal, or otherwise by implantation or inhalation. The subject compositions may be formulated into preparations in solid, semi-solid, liquid, or gaseous forms; including, but not limited to, tablets, capsules, powders, granules, ointments, solutions, suppositories, enemas, injections, inhalants, and aerosols. A nucleic acid molecule encoding an antibody may be coated onto gold microparticles and delivered intradermally by a particle bombardment device, or "gene gun," as described in the literature (see, e.g., Tang et al., *Nature* 356:152-154 (1992)). The appropriate formulation and route of administration may be selected according to the intended application.

In various embodiments, compositions comprising antibodies are provided in formulations with a wide variety of pharmaceutically acceptable carriers (see, e.g., Gennaro, *Remington: The Science and Practice of Pharmacy with Facts and Comparisons: Drugfacts Plus*, 20$^{th}$ ed. (2003); Ansel et al., *Pharmaceutical Dosage Forms and Drug Delivery Systems*, 7$^{th}$ ed., Lippencott Williams and Wilkins (2004); Kibbe et al., *Handbook of Pharmaceutical Excipients*, 3$^{rd}$ ed., Pharmaceutical Press (2000)). Various pharmaceutically acceptable carriers, which include vehicles, adjuvants, and diluents, are available. Moreover, various pharmaceutically acceptable auxiliary substances, such as pH adjusting and buffering agents, tonicity adjusting agents, stabilizers, wetting agents and the like, are also available. Non-limiting exemplary carriers include saline, buffered saline, dextrose, water, glycerol, ethanol, and combinations thereof.

In various embodiments, compositions comprising antibodies may be formulated for injection, including subcutaneous administration, by dissolving, suspending, or emulsifying them in an aqueous or nonaqueous solvent, such as vegetable or other oils, synthetic aliphatic acid glycerides, esters of higher aliphatic acids, or propylene glycol; and if desired, with conventional additives such as solubilizers, isotonic agents, suspending agents, emulsifying agents, stabilizers and preservatives. In various embodiments, the compositions may be formulated for inhalation, for example, using pressurized acceptable propellants such as dichlorodifluoromethane, propane, nitrogen, and the like. The compositions may also be formulated, in various embodiments, into sustained release microcapsules, such as with biodegradable or non-biodegradable polymers. A non-limiting exemplary biodegradable formulation includes poly lactic acid-glycolic acid polymer. A non-limiting exemplary non-biodegradable formulation includes a polyglycerin fatty acid ester. Certain methods of making such formulations are described, for example, in EP 1 125 584 A1.

Pharmaceutical packs and kits comprising one or more containers, each containing one or more doses of an antibody or combination of antibodiesare also provided. In some embodiments, a unit dosage is provided wherein the unit dosage contains a predetermined amount of a composition comprising an antibody or combination of antibodies, with or without one or more additional agents. In some embodiments, such a unit dosage is supplied in single-use prefilled syringe for injection. In various embodiments, the composition contained in the unit dosage may comprise saline, sucrose, or the like; a buffer, such as phosphate, or the like; and/or be formulated within a stable and effective Ph range. Alternatively, in some embodiments, the composition may be provided as a lyophilized powder that may be reconstituted upon addition of an appropriate liquid, for example, sterile water. In some embodiments, the composition comprises one or more substances that inhibit protein aggregation, including, but not limited to, sucrose and arginine. In some embodiments, a composition of the invention comprises heparin and/or a proteoglycan.

Pharmaceutical compositions are administered in an amount effective for treatment or prophylaxis of the specific indication. The therapeutically effective amount is typically dependent on the weight of the subject being treated, his or her physical or health condition, the extensiveness of the condition to be treated, or the age of the subject being treated. In general, antibodies may be administered in an amount in the range of about 10 µg/kg body weight to about 100 mg/kg body weight per dose. In some embodiments, antibodies may be administered in an amount in the range of about 50 gg/kg body weight to about 5 mg/kg body weight per dose. In some embodiments, antibodies may be administered in an amount in the range of about 100 µg/kg body weight to about 10 mg/kg body weight per dose. In some embodiments, antibodies may be administered in an amount in the range of about 100 µg/kg body weight to about 20 mg/kg body weight per dose. In some embodiments, antibodies may be administered in an amount in the range of about 0.5 mg/kg body weight to about 20 mg/kg body weight per dose.

The antibody compositions may be administered as needed to subjects. Determination of the frequency of administration may be made by persons skilled in the art, such as an attending physician based on considerations of the condition being treated, age of the subject being treated, severity of the condition being treated, general state of health of the subject being treated and the like. In some embodiments, an effective dose of an antibody is administered to a subject one or more times. In various embodiments, an effective dose of an antibody is administered to the subject once a month, less than once a month, such as, for example, every two months or every three months. In other embodiments, an effective dose of an antibody is administered more than once a month, such as, for example, every three weeks, every two weeks or every week. In some embodiments, an effective dose of an antibody is administered once per 1, 2, 3, 4, or 5 weeks. In some embodiments, an effective dose of an antibody is administered twice or three times per week. An effective dose of an antibody is administered to the subject at least once. In some embodiments, the effective dose of an antibody may be administered multiple times, including for periods of at least a month, at least six months, or at least a year.

In certain embodiments, the combination of the anti-VISTA antibody and a second agent discussed herein can be administered concurrently as a single composition in a pharmaceutically acceptable carrier, or concurrently as separate compositions with the anti-VISTA antibody and the second agent in a pharmaceutically acceptable carrier. In one embodiment, the combination of the anti-VISTA antibody and the second agent can be administered sequentially. The administration of the two agents can start at times that are, e.g., 30 minutes, 60 minutes, 90 minutes, 120 minutes, 3 hours, 6 hours, 12 hours, 24 hours, 36 hours, 48 hours, 3 days, 5 days, 7 days, or one or more weeks apart, or administration of the second agent can start, e.g., 30 minutes, 60 minutes, 90 minutes, 120 minutes, 3 hours, 6 hours, 12 hours, 24 hours, 36 hours, 48 hours, 3 days, 5 days, 7 days, or one or more weeks after the first agent has been administered.

Methods of Identifying Low pH Binding hVISTA-ECD Abs

Also provided herein are methods for identifying Abs that specifically bind to a VISTA-ECD protein in acidic (or low pH) conditions. In certain embodiments, a method for identifying an Ab that binds specifically to a VISTA-ECD protein at pH 6.5 or less comprises contacting a test Ab or plurality of test Abs with a VISTA-ECD protein at pH 6.5 or less, and selecting the test Ab if it binds to the ECD of the VISTA protein with a $K_D$ of $10^{-7}$ M, $10^{-8}$ M, $10^{-9}$ M or less. In some embodiments, the method is performed at pH 6.5, while in others it is performed at pH 6.0, or at pH 5.5, or at pH 5.0. In some embodiments, the VISTA-ECD protein is a hVISTA-ECD protein, or comprises the hVISTA IgV domain, or is a polypeptide comprising amino acids 20-95 of SEQ ID NO:2, or amino acids 20-70, 35-95, or 35-70 of SEQ ID NO:2. In some embodiments, the polypeptide also comprises amino acids 95-105 of SEQ ID NO:2. In some embodiments, the polypeptide comprises amino acids 35-127 or 37-125 of SEQ ID NO: 2.

In some embodiments, the method further comprises testing binding of the test Ab or plurality of test Abs at neutral, physiological or alkaline pH, such as at pH 7.0 or pH 7.4. In some embodiments, the method further comprises selecting an antibody if it not only binds to the VISTA-ECD protein with a $K_D$ of $10^{-7}$ M, $10^{-8}$ M, $10^{-9}$ M or less at pH 6.5 or lower, but also if it binds specifically to the polypeptide at pH 7.0 or pH 7.4. In some embodiments, test Abs are selected if they specifically bind to the VISTA-ECD protein in acidic conditions, e.g., at pH 6.5 or less, also specifically bind the VISTA-ECD protein at neutral and/or alkaline pH with similar affinity (i.e. they are "pan binders"). For example, some such Abs may bind to the VISTA-ECD protein with a $K_D$ of $10^{-7}$ M, $10^{-8}$ M, $10^{-9}$ M or less at both pH 6.5 and at pH 7.0 or pH 7.4 (at a constant temperature, e.g., of 25° C. or at 37° C.) such that the $K_D$ at pH 6.5 is within 1.5-fold of the $K_D$ at pH 7.0.

Certain Abs may be selected if they specifically bind to the VISTA-ECD protein in acidic conditions, e.g., at pH 6.5 or less with higher affinity than at neutral or alkaline pH ("pH sensitive binders" or "pH sensitive Abs"). For example, in some embodiments, Abs may bind to the VISTA-ECD protein with a $K_D$ of $10^{-8}$ M or less at pH 6.5 and with a $K_D$ of more than $10^{-8}$ M at pH 7.0 or pH 7.4. In some such embodiments, Abs may bind to the VISTA-ECD protein with a $K_D$ of $10^{-8}$ M or less at pH 6.5 and with a $K_D$ at pH 7.0 or pH 7.4 that is more than 1.5-fold higher than that at pH 6.5 In certain embodiments, a pH sensitive Ab is selected if it specifically binds to the VISTA-ECD protein with a $K_D$ that is at least 1.5 fold, 2 fold, 5 fold, 10 fold, 20 fold, 50 fold, 100 fold, 300 fold, 500 fold, 1000 fold, or 5000 fold lower at pH 6.5 than at pH 7.0 or pH 7.4 (at a constant temperature, e.g., of 25° C. or at 37° C.). For example, in some cases an Ab is selected if it binds to the VISTA-ECD protein with a $K_D$ that is at least 1.5 fold, 2 fold, 5 fold, 10 fold, 20 fold, 50 fold, 100 fold, 300 fold, 500 fold, 1000 fold, or 5000 fold less at pH 6.0, relative to pH 7.0 or pH 7.4 or higher (at a constant temperature, e.g., of 25° C. or at 37° C.).

In certain embodiments, an Ab is selected if it specifically binds to the VISTA-ECD protein with a $k_{off}$ that is lower in acidic conditions relative to that in neutral, physiological or alkaline conditions. In certain embodiments, an Ab is selected if it binds to the VISTA-ECD protein in acidic conditions with a $k_{off}$ that is at least 1.5 fold, 2 fold, 5 fold, 10 fold, 20 fold, 50 fold or 100 fold lower at pH 6.5 than the $k_{off}$ at pH 7.0 or pH 7.4, as measured, e.g., at 25° C. or at 37° C. For example, in some embodiments, an Ab is selected if it binds to the VISTA-ECD protein with a $k_{off}$ rate that is at least 1.5 fold, 2 fold, 5 fold, 10 fold, 20 fold, 50 fold or 100 fold lower at pH 6.0, relative to pH 7.0 or pH 7.4, as measured, e.g., at 25° C. or at 37° C.

In certain embodiments, an Ab is selected if it binds to the VISTA-ECD protein with a $k_{on}$ that is higher in acidic conditions relative to neutral or alkaline conditions. In certain embodiments, an Ab is selected if it binds to the VISTA-ECD protein in acidic conditions with a $k_{on}$ that is at least 2 fold, 5 fold, 10 fold, 20 fold, 50 fold or 100 fold higher at pH 6.5 than the $k_{on}$ at pH 7.0 or pH 7.4, as measured, e.g., at 25° C. or at 37° C. For example, in some embodiments, an Ab is selected if it binds to the VISTA-ECD protein with a $k_{on}$ that is at least 2 fold, 5 fold, 10 fold, 20 fold, 50 fold or 100 fold higher at pH 6.0 than at pH 7.0 or pH 7.4, as measured, e.g., at 25° C. or at 37° C.

Methods of Modifying the pH Sensitivity of VISTA-ECD Binding Abs

An Ab that binds to a VISTA-ECD protein, but does not do so at pH 6.5 or less, or does not do so with a high affinity at pH 6.5 or less, can be engineered to increase its affinity of binding at pH 6.5 or lower. For example, the paratope of an Ab may be mutated, e.g., by the substitution of one or more amino acid residues. For example, in some embodiments, 1 to 8, e.g., 1 to 6, 1 to 4, 1 to 3, 1 to 2 or 1 amino acid residues in the heavy or light chain of the Ab that are contact residues with VISTA-ECD (e.g. residues in one or more of the CDRs) may be replaced with a different amino acid residue. Then, the mutated Ab may be tested for binding to the VISTA-ECD protein at pH 6.5 or less and Ab species binding with higher affinity than the parent antibody may be selected. If desired, the steps above may be repeated so that two or more rounds of mutagenesis and selection are performed on the Abs and the highest affinity binders at the acidic pH are selected. In some embodiments, such selections may improve the antitumor efficacy of the resulting antibody over its parent.

The above selection method may also be designed to follow the previously described general selection for VISTA-ECD protein specifically binding antibodies. Namely, in certain embodiments, the improved Ab is selected if it binds to the ECD of the VISTA protein with a $K_D$ of $10^{-8}$ M or less at pH 6.5. In some embodiments, the selection is performed at pH 6.0, or at pH 5.5, or at pH 5.0 instead of at pH 6.5. In some embodiments, the VISTA-ECD protein used for the selection process is a complete hVISTA-ECD protein, or is a polypeptide that comprises the hVISTA IgV domain, or is a polypeptide comprising amino acids 20-95 of SEQ ID NO:2, or amino acids 20-70, 35-95, or 35-70 of SEQ ID NO:2. In some embodiments, the polypeptide also comprises amino acids 95-105 of SEQ ID NO:2. In some embodiment a polypeptide comprising amino acid residues 35-127of SEQ ID NO: 2 is used.

In some embodiments, a method for improving the binding of a VISTA antibody to VISTA ECD at acidic pH comprises increasing the number of glutamic acid, aspartic acid and/or histidine residues in one or more VH or VL CDRs, e.g., VH CDR1, CDR2 and CDR3 or only VH CDR1 and CDR3. In certain embodiments, a method comprises increasing the number of glutamic acid, aspartic acid and/or histidine residues in areas of the antibody that contacts hVISTA as determined, e.g., by crystallography.

In some embodiments, the method further comprises testing binding of the selected Ab at neutral, alkaline or physiological pH, such as at pH 7.0 or 7.4. In some embodiments, the method further comprises selecting an antibody if it not only binds to the VISTA-ECD protein with a $K_D$ of $10^{-8}$ M or less at pH 6.5 or lower, but also if it binds specifically to the polypeptide at pH 7.0 or 7.4. In some such embodiments, Abs are selected if they specifically bind to the VISTA-ECD protein in acidic conditions, e.g., at pH 6.5 or less, and also specifically bind the VISTA-ECD protein at neutral and/or alkaline or physiological pH with at similar affinity (i.e. they are "pan binders"). For example, some such Abs may bind to the VISTA-ECD protein with a $K_D$ of $10^{-8}$ M or less at both pH 6.5 and at pH 7.0 (at a constant temperature, e.g., of 25° C. or at 37° C.) such that the $K_D$ at pH 6.5 is within 1.5-fold of the $K_D$ at pH 7.0 or at pH 7.4.

Certain Abs may be selected if they specifically bind to the VISTA-ECD protein in acidic conditions, e.g., at pH 6.5 or less with higher affinity than at neutral, physiological, or alkaline pH ("pH sensitive binders" or "pH sensitive Abs"). For example, in some embodiments, Abs may bind to the VISTA-ECD protein with a $K_D$ of $10^{-8}$ M or less at pH 6.5 and with a $K_D$ of more than $10^{-8}$ M at pH 7.0. In some such embodiments, Abs may bind to the VISTA-ECD protein with a $K_D$ of $10^{-8}$ M or less at pH 6.5 and with a $K_D$ at pH 7.0 that is more than 1.5-fold higher than that at pH 6.5. In certain embodiments, a pH sensitive Ab is selected if it specifically binds to the VISTA-ECD protein with a $K_D$ that is at least 1.5 fold, 2 fold, 5 fold, 10 fold, 20 fold, 50 fold, 100 fold, 300 fold, 500 fold, 1000 fold, or 5000 fold lower at pH 6.5 than at pH 7.0 or pH 7.4 (at a constant temperature, e.g., of 25° C. or at 37° C.). For example, in some cases an Ab is selected if it binds to the VISTA-ECD protein with a $K_D$ that is at least 1.5 fold, 2 fold, 5 fold, 10 fold, 20 fold, 50 fold, 100 fold, 300 fold, 500 fold, 1000 fold, or 5000 fold less at pH 6.0, relative to pH 7.0 or pH 7.4 or higher (at a constant temperature, e.g., of 25° C. or at 37° C.).

In certain embodiments, the method further comprises determining $k_{off}$ at two pH values. In some such embodiments, an Ab is selected if it specifically binds to the VISTA-ECD protein with a $k_{off}$ that is lower in acidic conditions relative to that in neutral, physiological, or alkaline conditions. In certain embodiments, an Ab is selected if it binds to the VISTA-ECD protein in acidic conditions with a $k_{off}$ that is at least 1.5 fold, 2 fold, 5 fold, 10 fold, 20 fold, 50 fold or 100 fold lower at pH 6.5 than the $k_{off}$ at pH 7.0 or pH 7.4, as measured, e.g., at 25° C. or at 37° C. For example, in some embodiments, an Ab is selected if it binds to the VISTA-ECD protein with a $k_{off}$ rate that is at least 1.5 fold, 2 fold, 5 fold, 10 fold, 20 fold, 50 fold or 100 fold lower at pH 6.0, relative to pH 7.0, as measured, e.g., at 25° C. or at 37° C.

In certain embodiments, the method further comprises determining $k_{on}$ at two pH values. In some such embodiments, an Ab is selected if it binds to the VISTA-ECD protein with a $k_{on}$ that is higher in acidic conditions relative to neutral, physiological, or alkaline conditions. In certain embodiments, an Ab is selected if it binds to the VISTA-ECD protein in acidic conditions with a $k_{on}$ that is at least 2 fold, 5 fold, 10 fold, 20 fold, 50 fold or 100 fold higher at pH 6.5 than the $k_{on}$ at pH 7.0 or pH 7.4, as measured, e.g., at 25° C. or at 37° C. For example, in some embodiments, an Ab is selected if it binds to the VISTA-ECD protein with a $k_{on}$ that is at least 2 fold, 5 fold, 10 fold, 20 fold, 50 fold or 100 fold higher at pH 6.0 than at pH 7.0 or pH 7.4, as measured, e.g., at 25° C. or at 37° C.

Antibodies that bind preferentially to huVISTA at acidic pH, versus neutral or physiological pH can be identified by positively screening a library of VISTA antibodies or Fabs or scFvs for binding at acidic pH, e.g., pH 6.0 or 6.5, and negatively screening the library for the lack of binding at neutral pH, e.g., pH 7.0 or physiological pH, e.g., pH 7.4. A library may be enriched in glutamic acid, aspartic acid and histidine residues, such as to select binding domains that may be charged and more likely to bind to VISTA at acidic pH. The screening may involve positive selection at acidic pH and negative selections at neutral or physiological pH. The positive and negative selections may be alternated.

Alternatively, an antibody binding to VISTA at neutral and acidic pH can be engineered to lack binding at neutral pH and maintaining or even enhancing binding at acidic pH. For example, a library may be created by substituting VH and optionally VL amino acid residues, such as in one or more CDRs and screening the library by positive selection for antibodies that bind to hVISTA at acidic pH and negative selection for antibodies that do not bind to VISTA at neutral (or physiological) pH. A similar method may be used to engineer VISTA binding antibodies having the desired pH selective, pH dependent or pH independent VISTA binding profile.

Specific Embodiments

Additional embodiments of this disclosure include the following:

1. An isolated antibody (Ab) that specifically binds to human V-domain immunoglobulin-containing suppressor of T-cell activation (hVISTA) extracellular domain (ECD), wherein the Ab:
   a. Binds to hVISTA-ECD at pH 6.5 or less with an affinity constant ($K_D$) of $10^{-7}$ M or less;
   b. Binds to hVISTA-ECD at pH 6.5 or less with an off rate constant ($k_{off}$) of $10^{-3}$ sec$^{-1}$ or less; or
   c. Binds to hVISTA-ECD at pH 6.5 or less with a $K_D$ of $10^{-7}$ M or less and a $k_{off}$ of $10^{-3}$ sec$^{-1}$ or less.
2. The isolated Ab of embodiment 1, wherein the Ab binds to hVISTA-ECD at pH 6.5 or less with a $K_D$ of $10^{-8}$ M or less.
3. The isolated Ab of embodiment 2, wherein the Ab binds to hVISTA-ECD at pH 6.5 or less with a $K_D$ of $10^{-}$ M or less.
4. The isolated Ab of any one of embodiments 1-3, wherein the Ab binds to hVISTA-ECD at pH 6.5 or less with a $k_{off}$ of 10-4 sec$^{-1}$ or less.
5. The isolated Ab of any one of embodiments 1-4, wherein the Ab binds to hVISTA-ECD at pH 7.0 or higher with:
   a. a $K_D$ of $10^{-7}$ M or less;
   b. a $k_{off}$ of $10^{-3}$ sec$^{-1}$ or less; or
   c. a $K_D$ of $10^{-7}$ M or less and a $k_{off}$ of $10^{-3}$ sec$^{-1}$ or less.
6. The isolated Ab of embodiment 5, wherein the Ab binds to hVISTA-ECD at pH 7.0 or higher with a $K_D$ of $10^{-8}$ M or less.
7. The isolated Ab of embodiment 6, wherein the Ab binds to hVISTA-ECD at pH 7.0 or higher with a $K_D$ of $10^{-9}$ M or less.
8. The isolated Ab of any one of embodiments 5-7, wherein the Ab binds to hVISTA-ECD at pH 7.0 or higher with a $k_{off}$ of $10^{-4}$ sec$^{-1}$ or less.
9. The isolated Ab of any one of embodiments 5-8, wherein the Ab binds to hVISTA-ECD at pH 6.5 with similar affinity as at pH 7.0.
10. The isolated Ab of embodiment 9, wherein the Ab binds to hVISTA-ECD at pH 6.5 with higher affinity than at pH 7.0.
11. The isolated Ab of embodiment 10, wherein the Ab binds to hVISTA-ECD at pH 6.5 with a $K_D$ that is at least 1.5 fold lower than that at pH 7.0.
12. The isolated Ab of embodiment 11, wherein the Ab binds to hVISTA-ECD at pH 6.5 with a $K_D$ that is at least 2 fold lower than that at pH 7.0.
13. The isolated Ab of embodiment 11, wherein the Ab binds to hVISTA-ECD at pH 6.5 with a $K_D$ that is at least 5 fold lower than that at pH 7.0.
14. The isolated Ab of any one of embodiments 10-13, wherein the Ab binds to hVISTA-ECD at pH 6.5 with a $k_{off}$ that is lower than that at pH 7.0.
15. The isolated Ab of embodiment 14, wherein the Ab binds to hVISTA-ECD at pH 6.5 with a $k_{off}$ that is at least 1.5 fold lower than that at pH 7.0.
16. The isolated Ab of embodiment 15, wherein the Ab binds to hVISTA-ECD at pH 6.5 with a $k_{off}$ that is at least 2 fold lower than that at pH 7.0.
17. The isolated Ab of embodiment 16, wherein the Ab binds to hVISTA-ECD at pH 6.5 with a $k_{off}$ that is at least 5 fold lower than that at pH 7.0.
18. The isolated Ab of any one of embodiments 1-17, wherein the Ab specifically binds to hVISTA-ECD under conditions in which at least one histidine residue of hVISTA-ECD is protonated.
19. The isolated Ab of embodiment 18, wherein the Ab binds to the IgV domain of hVISTA-ECD.
20. The isolated Ab of embodiment 19, wherein the Ab binds to a region located within amino acids 20 and 95 of SEQ ID NO: 2.
21. The isolated Ab of embodiment 20, wherein the Ab binds to a region located within amino acids 20 and 70 of SEQ ID NO: 2.
22. The isolated Ab of embodiment 21, wherein the Ab binds to a region located within amino acids 35 and 70 of SEQ ID NO: 2.
23. The isolated Ab of any one of embodiments 20-22, wherein the Ab further binds to another region of the ECD of hVISTA.
24. The isolated Ab of embodiment 23, wherein the other region is located within amino acids 95 and 105 of SEQ ID NO: 2.
25. The isolated Ab of any one of embodiments 18-24, wherein binding is determined by hydrogen-deuterium exchange mass spectrometry (HDX-MS).
26. The isolated Ab of any one of embodiments 1-25, wherein the Ab inhibits binding of hVISTA to a cell to which hVISTA would otherwise bind.
27. The isolated Ab of any one of embodiments 1-26, wherein the Ab triggers or enhances an immune response in a tumor model.
28. The isolated Ab of embodiment 27, wherein the Ab triggers or enhances T cell activity in a tumor model.
29. The isolated Ab of any one of embodiments 1-28, wherein the Ab inhibits tumor growth in a tumor model.
30. The isolated Ab of any one of embodiments 1-29, wherein the Ab inhibits binding of hVISTA to T cells.
31. The Ab of embodiment 30, wherein the Ab more strongly inhibits binding of hVISTA to T cells at pH 6.5 or less than at pH 7.0 or higher, such as wherein the antibody more strongly inhibits binding of hVISTA to T cells a pH 6.5 than at pH 7.0.
32. A composition comprising an isolated Ab of any one of embodiments 1-31 and a pharmaceutically acceptable carrier.
33. A method of treating a subject having cancer, comprising administering to the subject a composition of embodiment 32.
34. A method for identifying an Ab that binds to hVISTA-ECD at pH 6.5 or less with a $K_D$ of $10^{-7}$ M or less, comprising contacting a test Ab or a plurality of test Abs with a polypeptide comprising hVISTA-ECD or a fragment thereof comprising the IgV domain of hVISTA-ECD or comprising amino acids 20-95, 20-70, or 35-70 of SEQ ID NO:2 at pH 6.5 or less, and selecting the test Ab or Abs that bind to the polypeptide with a Kr) of $10^{-7}$ M or less.
35. A method for identifying an Ab that binds to hVISTA-ECD at pH 6.5 or less with a $k_{off}$ of $10^{-3}$ sec$^{-1}$ or less, comprising contacting a test Ab or a plurality of test Abs with a polypeptide comprising hVISTA-ECD or a fragment thereof comprising the IgV domain of hVISTA-ECD or comprising amino acids 20-95, 20-70, or 35-70 of SEQ ID NO:2 at pH 6.5 or less, and selecting the test Ab or Abs that bind to the polypeptide with a $k_{off}$ of $10^{-3}$ sec$^{-1}$ or less.

36. A method for identifying an Ab that specifically binds to hVISTA-ECD at pH 6.5 with similar affinity at pH 7.0 comprising:
  a. contacting a test Ab or plurality of test Abs at pH 6.5 with a polypeptide comprising hVISTA-ECD or a fragment thereof comprising the IgV domain of hVISTA-ECD or comprising amino acids 20-95, 20-70, or 35-70 of SEQ ID NO:2;
  b. contacting the test Ab or plurality of test Abs at pH 7.0 with the polypeptide of (a); and
  c. selecting a test Ab if it binds to the polypeptide with a $K_D$ of $10^{-7}$ M or less at pH 6.5 and at pH 7.0.

37. A method for identifying an Ab that binds with higher affinity to hVISTA-ECD at pH 6.5 than at pH 7.0 comprising:
  a. contacting a test Ab or plurality of test Abs at pH 6.5 with a polypeptide comprising hVISTA-ECD or a fragment thereof comprising the IgV domain of hVISTA-ECD or comprising amino acids 20-95, 20-70, or 35-70 of SEQ ID NO:2;
  b. contacting the test Ab or plurality of test Abs at pH 7.0 with the polypeptide of (a); and
  c. selecting a test Ab if it binds to the polypeptide with a $K_D$ at least 2-fold lower at pH 6.5 than at pH 7.0.

38. A method for identifying an Ab that specifically binds to hVISTA-ECD for use in treating cancer, comprising
  a. identifying Abs that specifically bind to hVISTA-ECD at pH 6.5 or less, such as according to the methods of embodiments 32-35; and
  b. selecting the Abs of (a) that trigger or enhance an immune response in a tumor model or that inhibit tumor growth at pH 6.5 or less.

39. The method of embodiment 38, wherein step (b) comprises measuring T cell activity.

40. The method of embodiment 38 or 39, further comprising measuring the anti-tumor effect of the Ab.

41. A method for improving the anti-tumor efficacy of an Ab that binds to hVISTA-ECD, comprising a. Providing an Ab that binds to hVISTA-ECD at pH 6.5 or less with an affinity that is less than a desired value, e.g., with a $K_D$ of $10^{-7}$ M or more, e.g., $10^{-6}$ M, $10^{-5}$ M or more and/or $k_{off}$ of $10^{-2}$ sec$^{-1}$ or more;
  b. Replacing 1 to 5 amino acid residues in the heavy or light chain of the Ab with a different amino acid residue, wherein the 1 to 5 amino acid residues are contact residues with hVISTA-ECD;
  c. Determining if the Ab obtained in (b) has higher affinity for hVISTA-ECD at pH 6.5 or less relative to the Ab of (a); and
  d. Repeating steps (a)-(c), for a number of rounds sufficient to obtain an Ab that binds to hVISTA-ECD at pH 6.5 or less with a $K_D$ of $10^{-7}$ M or less.

42. A method for improving the anti-tumor efficacy of an Ab that binds to hVISTA-ECD, comprising:
  a. Providing an Ab that binds to hVISTA-ECD at pH 6.5 or less with an affinity that is less than a desired value, e.g., with a $K_D$ of $10^{-7}$ M or more, e.g., $10^{-6}$ M, $10^{-5}$ M or more and/or $k_{off}$ of $10^{-2}$ sec$^{-1}$ or more;
  b. Preparing a library of variants of the Ab of (a), wherein each variant comprises a substitution of 1 to 5 amino acid residues in the heavy or light chain of the Ab with a different amino acid residue, wherein the 1 to 5 amino acid residues are contact residues with hVISTA-ECD;
  c. Selecting Abs of the library of variants of (b) that bind to hVISTA-ECD at pH 6.5 or less with a $K_D$ of $10^{-7}$ M or less; and optionally,
  d. Testing the anti-tumor efficacy of the Abs of (c) in a tumor model.

43. A method for improving the pharmacokinetics of an antibody that binds to human VISTA ECD, comprising enhancing the ability of the antibody to bind to human VISTA in acidic conditions, e.g., equal to or lower than pH 6.5.

44. A method for selecting an antibody that binds to human VISTA and having an extended half-life (good pharmacokinetic properties), wherein the method comprises selecting an antibody that binds to human VISTA in acidic conditions, e.g., equal to or lower than pH 6.5.

Further exemplary embodiments are provided in the claims below.

EXAMPLES

The examples discussed below are intended to be purely exemplary of the invention and should not be considered to limit the invention in any way. The examples are not intended to represent that the experiments below are all or the only experiments performed. Efforts have been made to ensure accuracy with respect to numbers used (for example, amounts, temperature, etc.) but some experimental errors and deviations should be accounted for. Unless indicated otherwise, parts are parts by weight, molecular weight is average molecular weight, temperature is in degrees Centigrade, and pressure is at or near atmospheric.

Example 1: VISTA's Extracellular Domain is Exceptionally Rich in Histidines

This example shows that VISTA's extracellular domain is exceptionally rich in histidine residues, that these histidine residues are evolutionarily conserved, and that they may contribute to receptor-ligand interactions involving VISTA.

The amino acid sequences of the extracellular domains (ECDs) of immunoglobulin domain-containing proteins were extracted from the uniprot and swiss-prot databases and analyzed for histidine content. FIG. 1A depicts the results of this analysis as a graph. For each protein, the frequency of histidine residues as a percentage of all extracellular domain amino acid residues is plotted on the y-axis, and the total number of extracellular domain amino acid residues is plotted on the x-axis. The diameter of each data point corresponds to the total number of histidine residues in the extracellular domain of each protein. VISTA (labeled) contains an exceptionally high frequency of histidine residues in its extracellular domain.

The evolutionary conservation of histidine residues in VISTA was then assessed. FIG. 1B shows the amino acid reference sequences of human, cynomolgus macaque, and mouse VISTA were aligned, excluding the signal peptides ("Sig"), transmembrane domains ("TMD") and intracellular domains. Histidine residues that are conserved across all three species are bolded and underlined. Histidine residues that are conserved across human and cyno VISTA are bolded without underlining. Many of VISTA's extracellular domain histidine residues are evolutionarily conserved, suggesting an important biological role for VISTA's high histidine content.

Figure 1C:
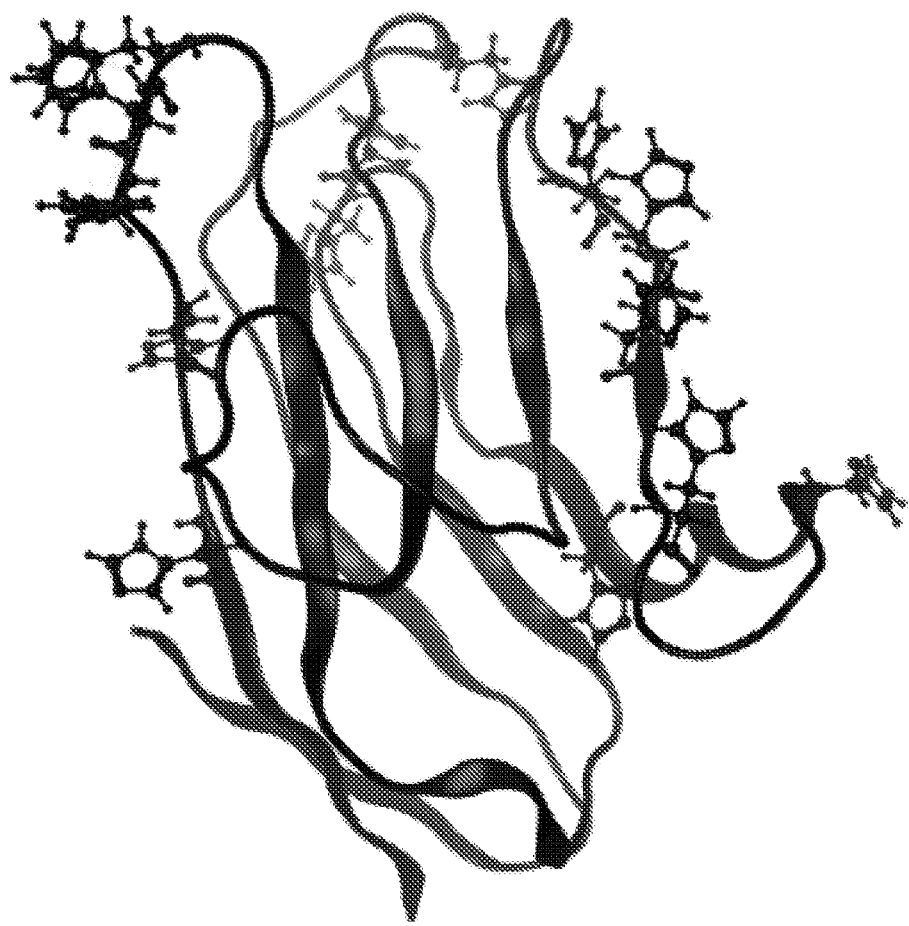

A three-dimensional model of the hVISTA IgV domain was created based on sequence homology analysis to available solved structures in the PDB database. The model, shown in FIG. 1C, indicates that many histidines in VISTA's ECD are exposed at the surface of the molecule, where they may play a role in ligand binding as well as in antibody recognition. Histidine residues are depicted as balls and sticks.

Example 2: Histidine Protonation May Regulate VISTA Receptor-Ligand Engagement and Immunosuppressive Activity in Tumors and Other Acidic Microenvironments This Example describes histidine protonation in response to physiologically relevant acidic pH, as well as a model in which VISTA extracellular domain histidines confer counter-receptor or ligand selectivity for acidic pH rather than physiological pH.

Figure 2A:
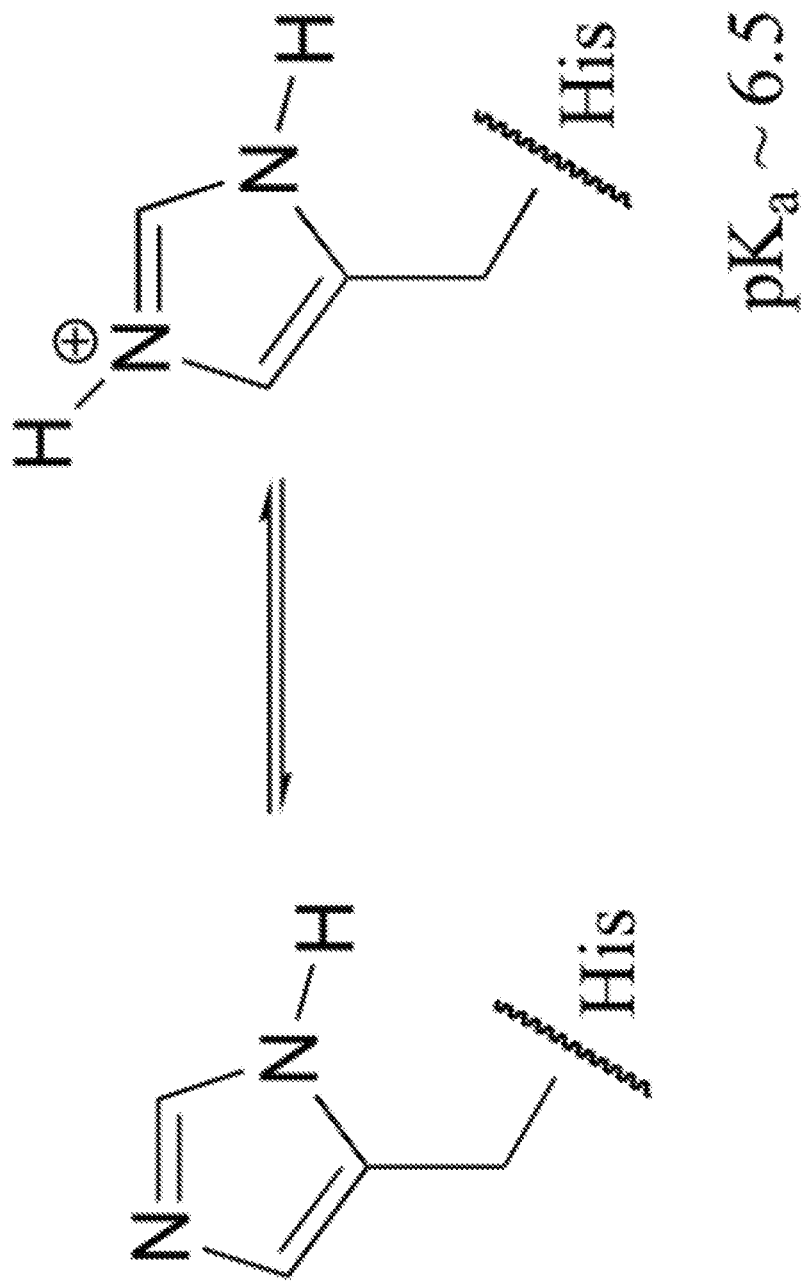
FIGS. 2A-B show a model in which the histidine residues in VISTA's extracellular domain confer counter-receptor selectivity for acidic pH rather than physiological pH.

FIG. 2A shows the equilibrium between the lack of, and the presence of, protonation of the pyrrole ammonium group (NH) in a histidine residue. The pKa of histidine in solution is 6.5, indicating that histidine residues are more likely to be protonated at pH 6.5 and lower, and thus, positively charged, than at higher pH. The increase in positive charge at the surface of the VISTA ECD as a result of protonation may affect receptor or ligand binding as well as VISTA structure and/or function. Thus, changes in pH may also modify antibody binding epitopes and/or result in varied antibody affinities.

Figure 2B:
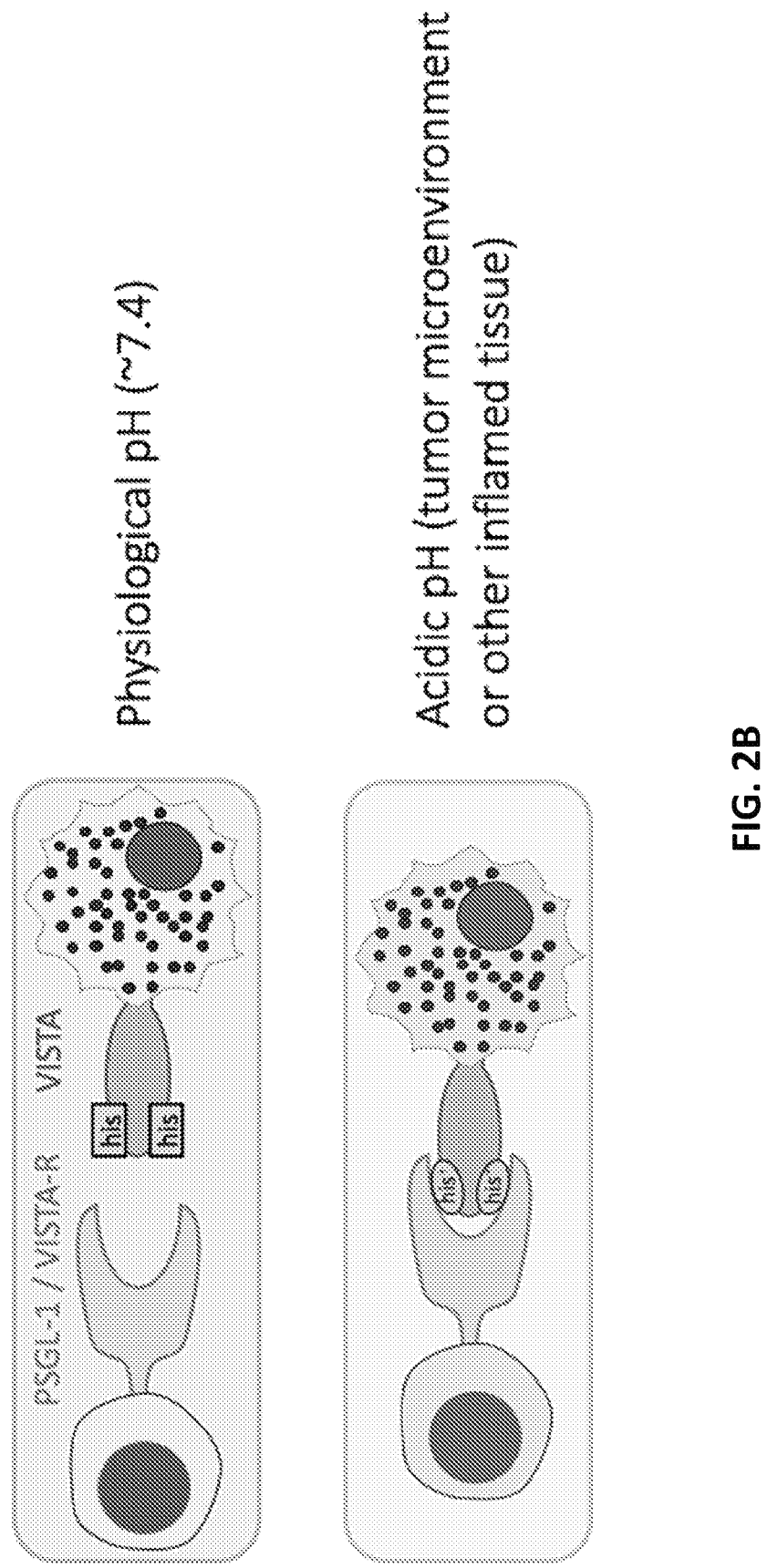

FIG. 2B shows a model in which VISTA engages PSGL-1 or other counter-receptors and ligands ("VISTA-R") selectively at acidic pH. At physiological pH, such as in the blood, histidine residues on VISTA's ECD are expected to be non-protonated. As a result, VISTA binding to PSGL-1 or other counter-receptors and ligands is neglible at physiological pH. In contrast, in locations that tend to have an acidic extracellular pH, such as tumor microenvironments or sites of inflammation, acidic pH may partially or fully drive VISTA ECD histidine protonation and thus enable VISTA engagement with PSGL-1 or other counter-receptors and ligands. Accordingly, antibodies that bind strongly to VISTA-ECD proteins at acidic pH ranges may be more effective in inhibiting VISTA activity in tumors.

Example 3: VISTA is Expressed by Myelomonocytic Cells in Tumors

This Example shows that VISTA is frequently expressed by myelomonocytic cells in tumors, including macrophages, dendritic cells, and granulocytes.

Figure 3:
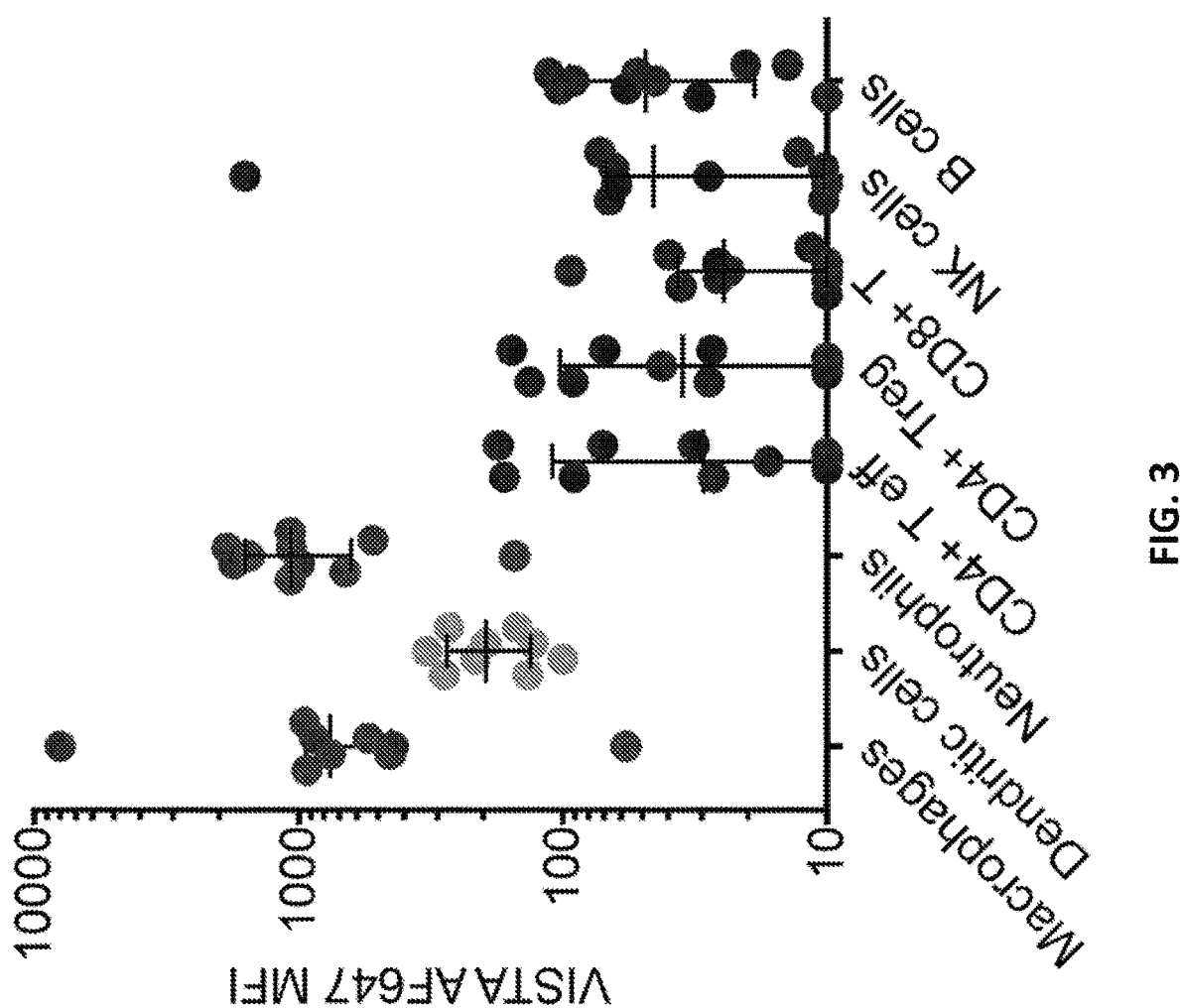
FIG. 3 shows the level of VISTA surface expression (mean fluorescence intensity (MFI) of anti-VISTA antibody staining) on tumor-infiltrating macrophages, dendritic cells, neutrophils, CD4+ effector T cells, CD4+ regulatory T cells, CD8+ T cells, natural killer (NK) cells, and B cells. VISTA is expressed on many tumor-infiltrating leukocytes, particularly myeloid cells. Tumor microenvironments are often acidic, enabling VISTA to engage counter-receptors and ligands.

Surgically resected non-small cell lung carcincoma, renal clear cell carcinoma, melanoma, colorectal carcinoma, and other tumor samples were washed in ice-cold PBS, cut into approximately 15 mm$^3$-sized pieces, and suspended in ice-cold RPMI-1640 media (Fisher Scientific catalog number 11875093) supplemented with 2% heat-inactivated FBS and 2 mM EDTA (Fisher Scientific 15575020). Each sample was transferred to a large clearance glass dounce (Tenbroeck Tissue Grinders) and ground until the tissue pieces were visually disassociated. The suspensions were filtered through 70 μM nylon mesh and centrifuged. The supernatants were discarded and the cell pellets were re-suspended in room-temperature PBS supplemented with 0.1% bovine serum albumin and 250 mg/mL sterile-filtered DNase 1 (grade II, from bovine pancreas, Roche catalog number 10104159001) for 3 minutes at room temperature. The cells were then washed in ice-cold supplemented RPMI and re-suspended in ice-cold PBS. A cell viability dye was added and the cells were incubated on ice in the dark. After 20 minutes, non-specific antibody staining was blocked by adding 4% normal rat serum, 4% normal mouse serum, 20% human serum from AB plasma, and 1:125 diluted Human TruStain FcX™ (Biolegend catalog number 422302). The cells were stained with fluorophore-conjugated antibodies against HLA-DR (BD Biosciences catalog number 564040), CD8 (Fisher Scientific catalog number 46-0087-42), CD14 (Biolegend catalog number 325620), CD45 (Biolegend catalog number 304017), CD4 (BD Biosciences catalog number 563875), CD11c (BD Biosciences catalog number 744439), CD15 (BD Biosciences catalog number 563142), PD-1 (BD Biosciences catalog number 565299), CD3 (BD Biosciences catalog number 565515), CD56 (Fisher Scientific catalog number 61-0567-42), CD19 (BD Biosciences catalog number 564977), and VISTA (VISTA antibody 3 conjugated to AlexaFluor™ 647, Fisher Scientific catalog number A20186) suspended in Brilliant Stain Buffer (BD Biosciences catalog number 562794) for 30 minutes on ice in the dark. The stained cells were washed in ice-cold PBS, fixed (Fisher Scientific catalog number 00-5523-00), and acquired on a flow cytometer. Data were analyzed using FlowJo™ software (BD Biosciences). As shown in FIG. 3, VISTA cell surface expression was highest on macrophages and granulocytes, moderate on dendritic cells, and low on T cells, natural killer cells, and B cells.

Example 4: VISTA Cell Binding Exhibits Acidic pH Selectivity

This Example shows that multimerized human VISTA ECD binds more efficiently to stimulated human CD4+ T cells and human peripheral blood mononuclear cells at acidic pH than at neutral or physiological pH, and that this binding can be blocked by an anti-human VISTA locking antibody. Acidic pH-selective-dimerized mouse VISTA ECD binding to mouse splenocytes is also shown.

Human CD4+ T cells were enriched from healthy donor blood by RosetteSep™ (Stemcell catalog number 15062) and stimulated in vitro for approximately four days with Human T-Activator CD3/CD28 Dynabeads™ (Fisher Scientific catalog number 111.32D) and recombinant human IL-2 (Peprotech catalog number 200-02) in RPMI-1640 supplemented with 10% heat-inactivated FBS, Glutamax™ (Fisher Scientific catalog number 35050061), non-essential amino acids (Fisher Scientific 11140050), sodium pyruvate (Fisher Scientific catalog number 11360070), and 2-mercaptoethanol (Fisher Scientific 21985023). The activated CD4+ T cells were stained with monobiotinylated hVISTA ECD molecules (Phe 33-Ala 194 (Accession #AAH20568)-polyhistidine; AcroBiosystems, Inc. B75-H82F3) loaded at a 28:1 molar ratio onto Phycoerythrin (PE)-conjugated streptavidin dextramers (catalog number DX01-PE) diluted into Hank's Buffered Salt Solution (HBSS, Fisher Scientific catalog number 14025134) acidified to various pH with mM MES (Sigma, 1317-100 ML) for 30 minutes at room temperature. As a control, activated CD4+ T cells were stained with PE-conjugated streptavidin dextramers that were not loaded with hVISTA. The stained cells were washed with HBSS+MES and acquired on a flow cytometer. Data were analyzed using FlowJo™ software (BD Biosciences). The results, depicted in FIG. 4A, show that hVISTA did not bind CD4+ T cells better than the control at pH>6.5. In contrast, hVISTA exhibited progressively stronger binding to CD4+ T cells at pH<6.5. Left, from darker gray to lighter, the filled histograms depict binding at pH 7.0, 6.5, 6.4, 6.3, 6.1, and 6.0. Some histograms are labeled with their corresponding pH. Non-VISTA control multimer binding at pH 6.0 is shown as the unfilled histogram. Right, graphed PE mean fluorescence intensities (MFI) of CD4+ T cells stained with hVISTA-loaded dextramers (circles) or with non-loaded dextramers (triangles) at various pH.

Figure 4B:
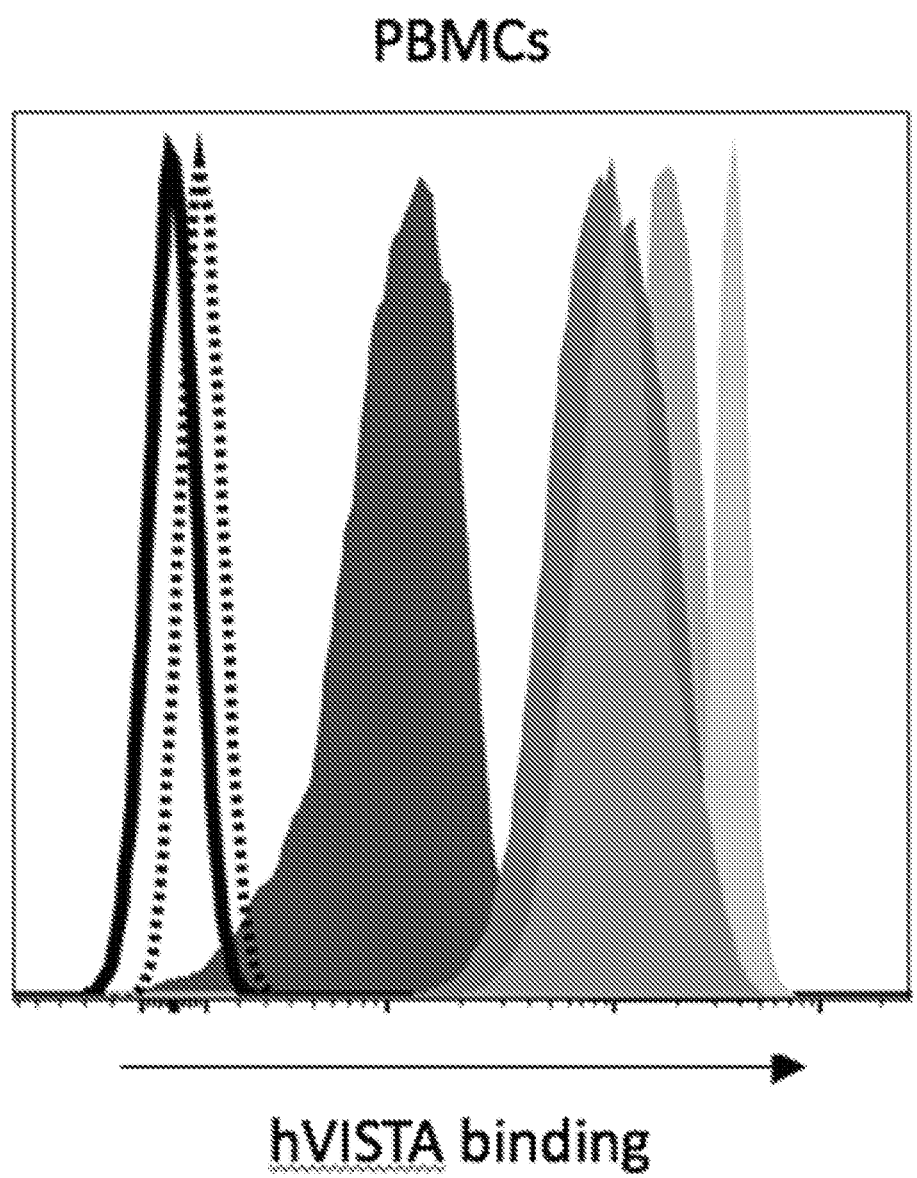
Figure 4C:
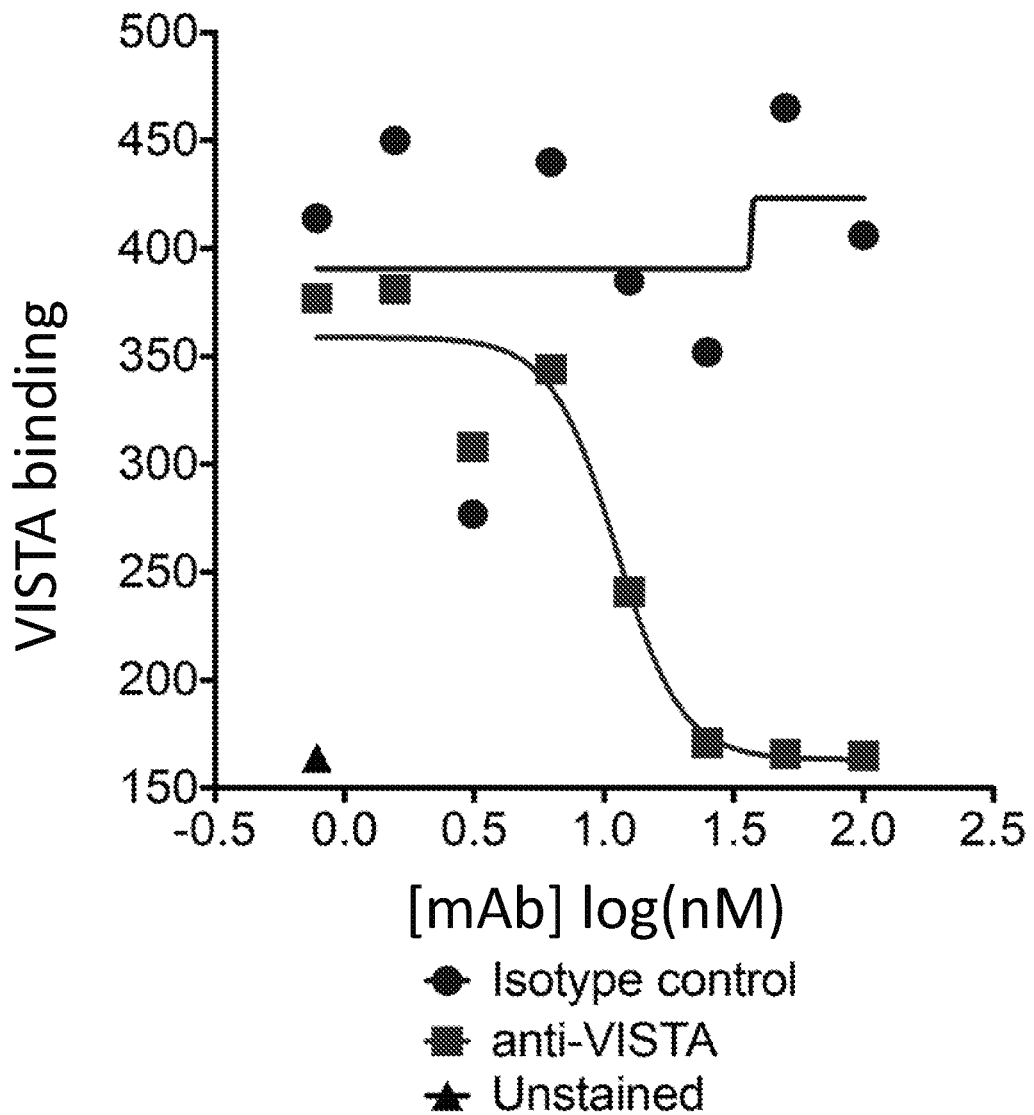

Peripheral blood mononuclear cells (PBMC) were enriched from healthy donor blood by ficoll gradient centrifugation (Ficoll-Paque Plus, GE Life Sciences catalog number 17144003) and stained with hVISTA-loaded dextramers (also referred to as multimers) and fluorophore-conjugated diluted in HBSS+MES buffers as described above. FIG. 4B shows filled histograms that depict, from darker gray to lighter, binding at pH 6.0 to CD19+B cells, CD4+ T cells, CD8+ T cells, CD56+NK cells, and CD14+ monocytes. The unfilled, solid border and dotted border histograms depict binding at pH 7.4 to total PBMC lymphocytes and monocytes respectively. FIGS. 4F and 4G show that VISTA binds to both monocytes and neutrophils, and does so more strongly at pH 6.0 than at pH 7.4. The results show that hVISTA can bind many leukocytes at acidic pH but not significantly at physiological pH.

Activated human CD4+ T cells were stained with hVISTA multimers at pH 6 in the presence of titrated anti-human VISTA antibody or an isotype-matched non-VISTA-specific antibody. The results, graphed in FIG. 4C, show VISTA multimer MFI relative to antibody concentration. Anti-hVISTA antibody (VISTA antibody 3; squares), but not the non-VISTA-specific control antibody (circles), blocked hVISTA binding to activated CD4+ T cells in a concentration-dependent manner. The PE MFI of CD4+ T cells that were not stained with hVISTA-loaded multimers is included as a control (single triangle).

Figure 4D:
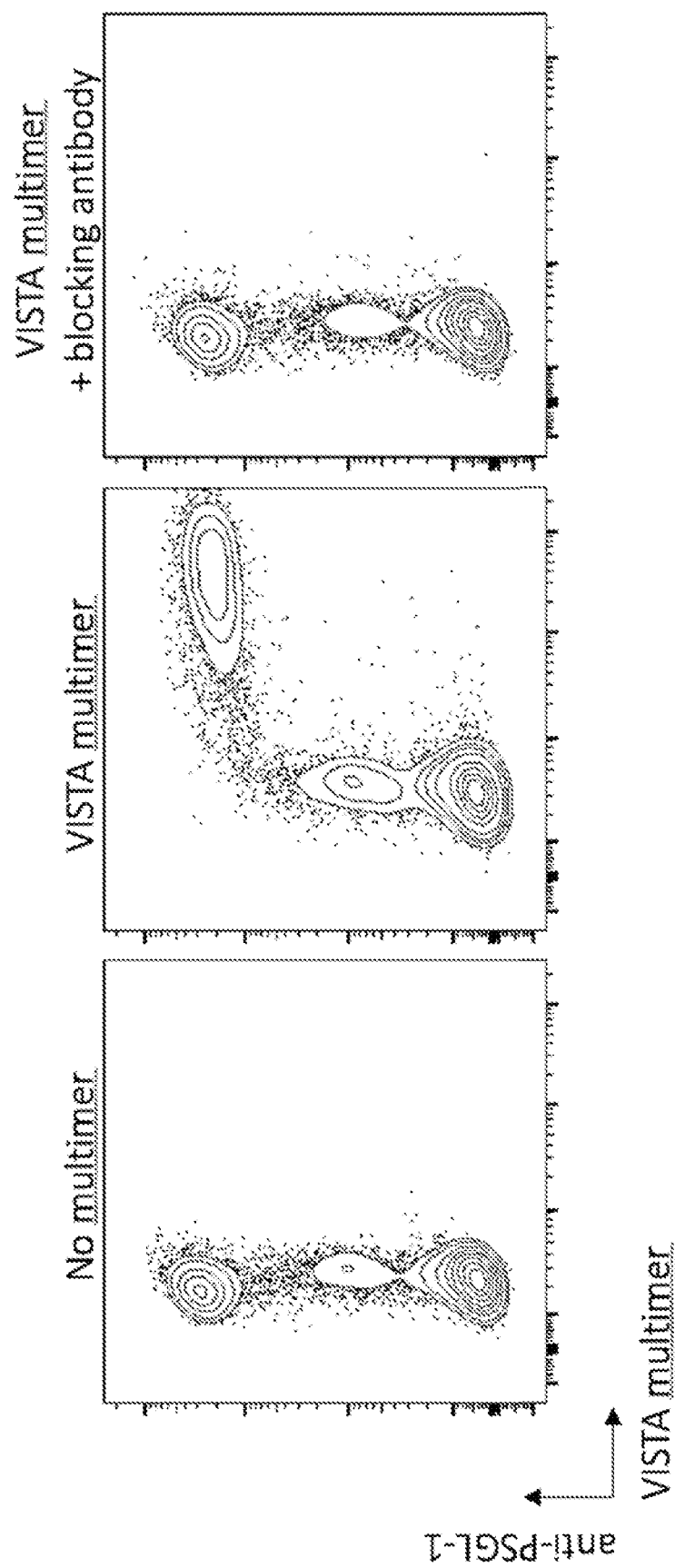

FIG. 4D shows representative two-dimensional flow cytometry plots of VISTA multimer staining at pH 6.0 to heparan sulfate-mutant Chinese Hamster Ovary (CHO) cells (line pGSD-677, American Type Culture Collection) that were transfected to express full length human PSGL-1 (SEQ ID NO: 3; nucleic acid NM_003006.4). Staining was performed in the presence or absence of a titrated anti-VISTA blocking antibody (mAb 3). Cells left unstained by VISTA multimers are shown as a control. PSGL-1 antibody (BD Biosciences catalog number 562758) staining is plotted on the y-axis, and VISTA multimer staining is plotted on the x-axis.

Figure 4E:
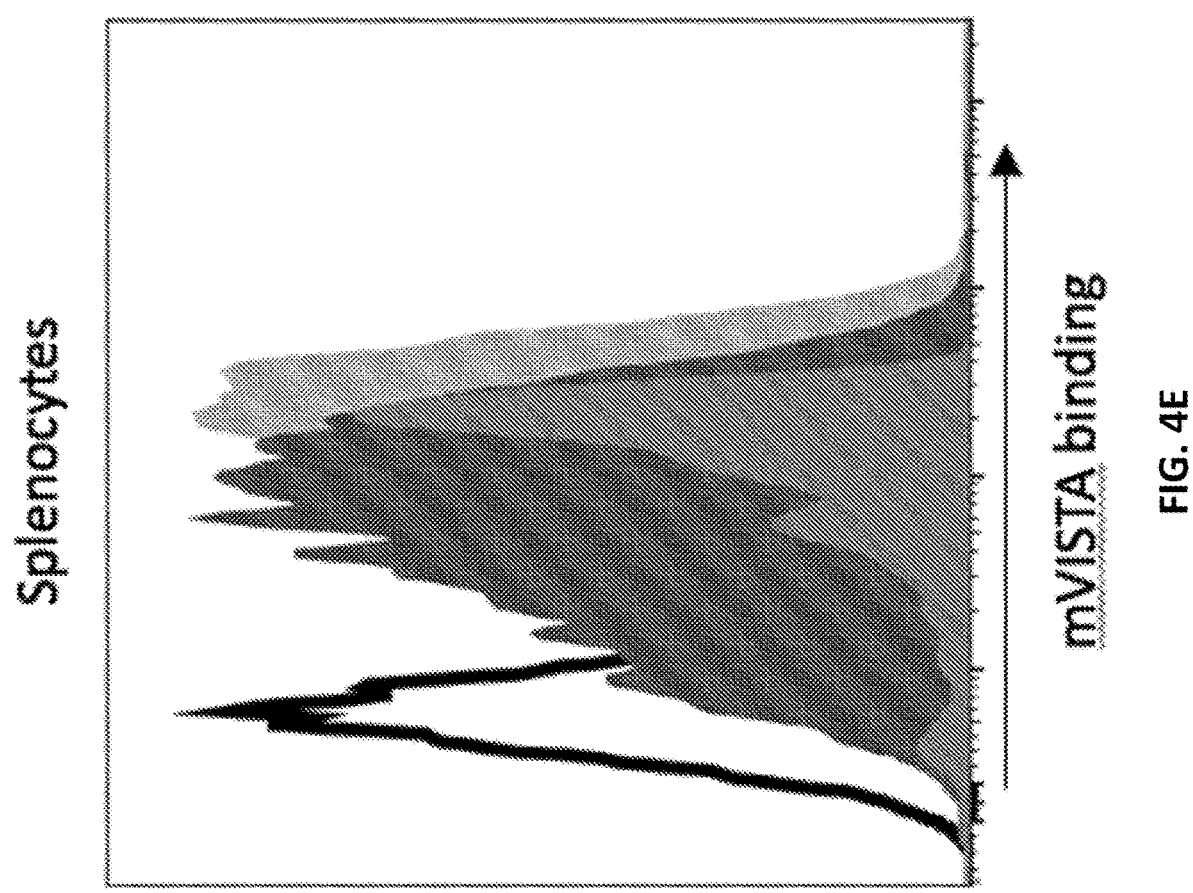
Figures 4F, 4G:
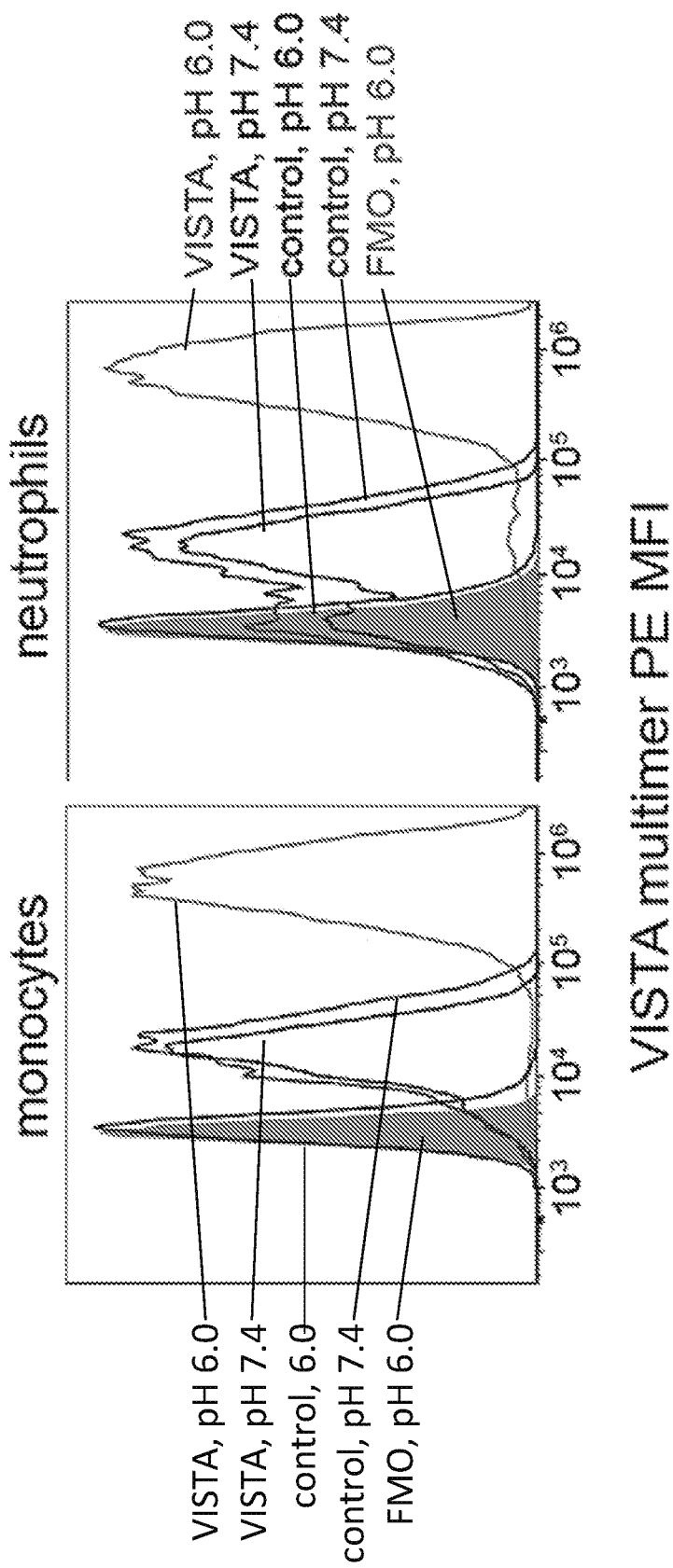

Splenocytes were collected from C57BL6/J mice (Jackson Laboratory catalog number 000664) and stained with mVISTA ECD/human IgG Fc (Fragment, crystallizable) chimeric fusion proteins followed by fluorophore-conjugated anti-human IgG Fc secondary antibodies (Jackson Immunoresearch catalog number 109-065-098) at pH 6.0 or 7.4. The results, depicted by histogram in FIG. 4E, show that mVISTA binds murine splenocytes more efficiently at pH 6.0 than at physiological pH (approximately pH 7.4). From darker gray to lighter, the filled histograms depict binding at pH 6.0 to CD8+ T cells, CD11b+ myeloid cells, and CD4+ T cells. The unfilled histogram depicts binding at pH 7.4 to total splenocytes.

Example 5: VISTA Mediates Cell: Cell Adhesion and Immune Suppression Selectively at Acidic pH This Example shows that VISTA mediates cell: cell adhesion and suppresses T cell activation more potently at acidic pH than at neutral or physiological pH.

Figures 5A, 5B:
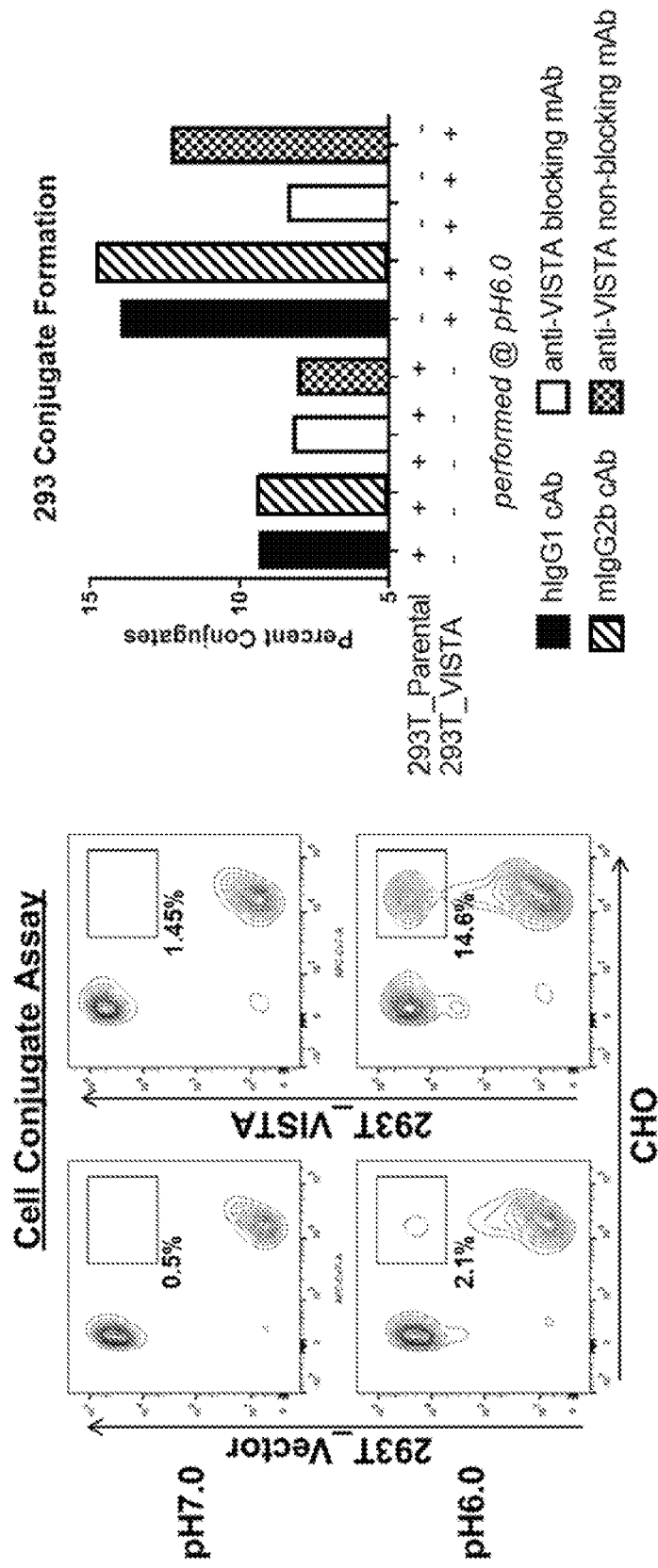
FIGS. 5A-D show that VISTA mediates T cell suppression and cell: cell adhesion preferentially at acidic pH, and that both effects can be reversed with an anti-VISTA blocking antibody.

An acidic pH-compatible flow cytometry-based cell/cell conjugate assay was established. 293T cells (an immortalized human embryonic kidney cell line, ATCC catalog number CRL-3216) ectopically expressing full-length human VISTA or vector were labeled with CFSE (Carboxyfluorescein succinimidyl ester; Fisher Scientific catalog number C34554). CHO cells were labeled with CellTrace™ Far Red (Fisher Scientific catalog number C34564). The Vector or VISTA 293T cells were then mixed at a 1:1 ratio with CHO cells in pH7.0 or pH6.0 buffers and incubated for 1 hour at room temperature. The formation of CHO and 293T cell/cell conjugates was assessed by flow cytometry. The results shown in FIGS. 5A-B demonstrate that VISTA-expressing 293T cells preferentially adhere to CHO cells at acidic pH and that inclusion of an anti-VISTA blocking antibody (VISTA mAb 3; white bars) inhibits VISTA mediated cell/cell adhesion.

Figure 5D:
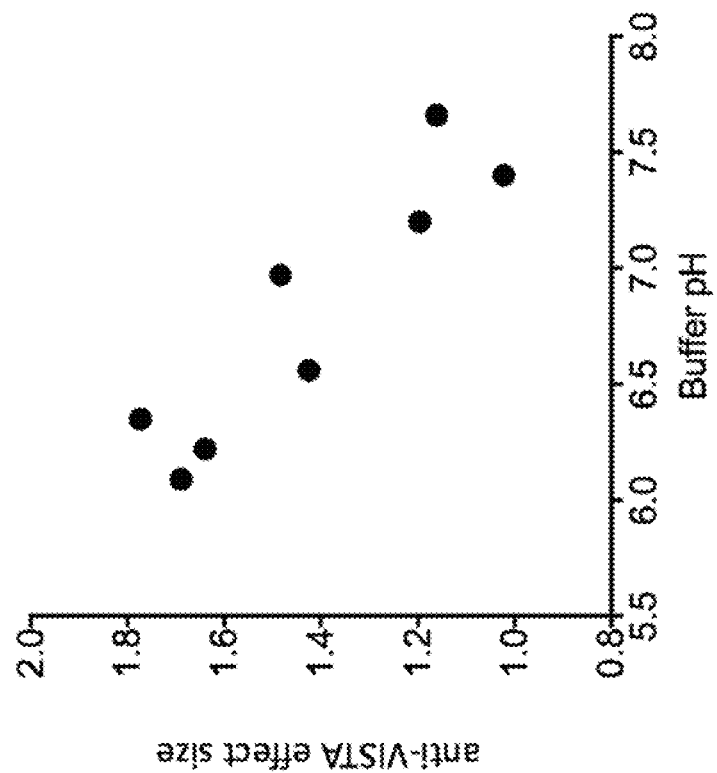
Figure 5C:
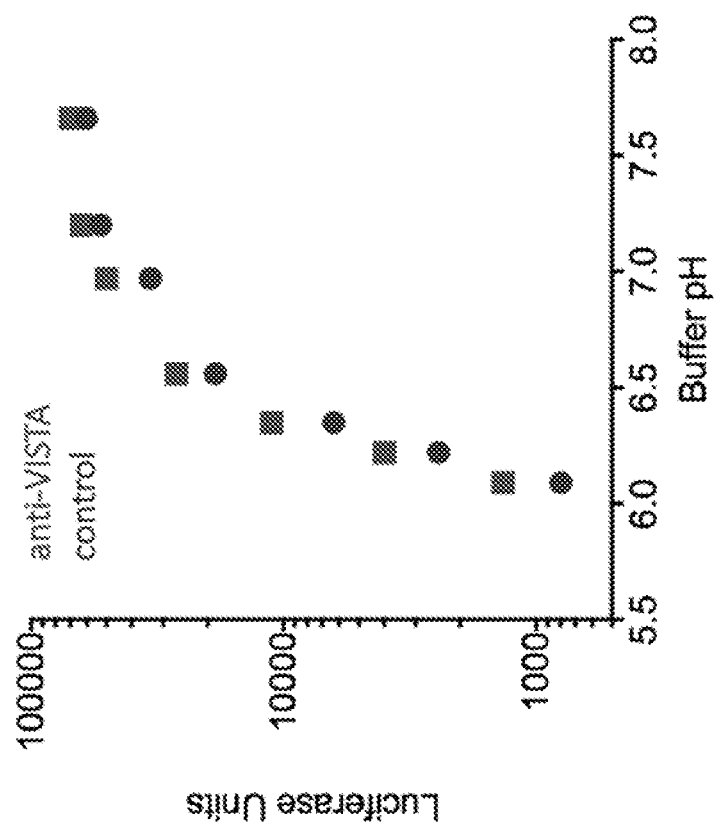

An acidic pH-compatible T cell suppression assay was established. Jurkat cells (an immortalized human T cell line, ATCC catalog number TIB-152) expressing an NFkB promoter driven luciferase reporter were co-cultured in HBSS+MES buffers of various pH with 293T cells (an immortalized human embryonic kidney cell line, ATCC catalog number CRL-3216) ectopically expressing full-length human VISTA and a single-chain variable fragment of the anti-human T cell receptor agonist antibody clone OKT3 at a 10:1 Jurkat: 293T cell ratio. An anti-VISTA blocking antibody (VISTA mAb 3) or an isotype-matched non-VISTA-specific control antibody were added at 10 μg/mL to the co-cultures. After incubation, Jurkat T cell activation was quantified by measuring luciferase activity (1 second interval Promega catalog number G7940). The results are shown in FIG. 5C-D. FIG. 5C shows a plot of luciferase units in Jurkats treated with anti-VISTA (squares) or control antibody (circles) at different pH. FIG. 5D shows a plot of the luciferase signal in anti-VISTA antibody-treated co-cultures divided by the luciferase signal in control antibody-treated co-cultures at each pH tested. The results show that VISTA-mediated T cell suppression is most potent at acidic pH.

Example 6: VISTA Traffics Through Intracellular Recycling Endosomes

This Example shows that VISTA can be found in intracellular endosomes, particularly Rab11+ recycling endosomes, and can recycle to and from the cell surface via endosomal trafficking. The strength with which an anti-VISTA antibody binds VISTA at acidic pH influences its capacity to remain bound to VISTA during endosomal trafficking.

Figure 6A:
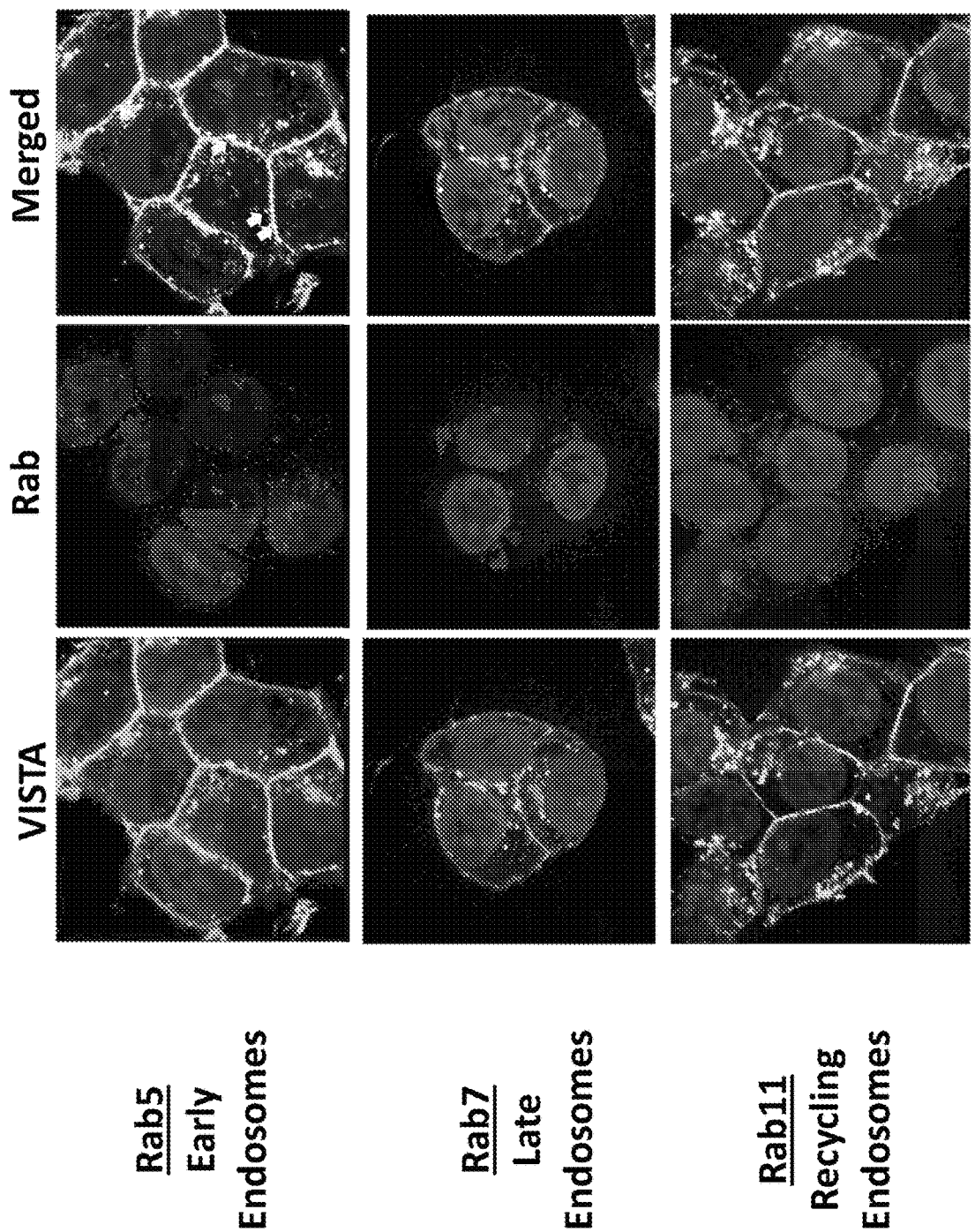
FIGS. 6A-G show that VISTA can be found in intracellular endosomes, particularly Rab11+ recycling endosomes, and can recycle to and from the cell surface via endosomal trafficking.
Figure 6B:
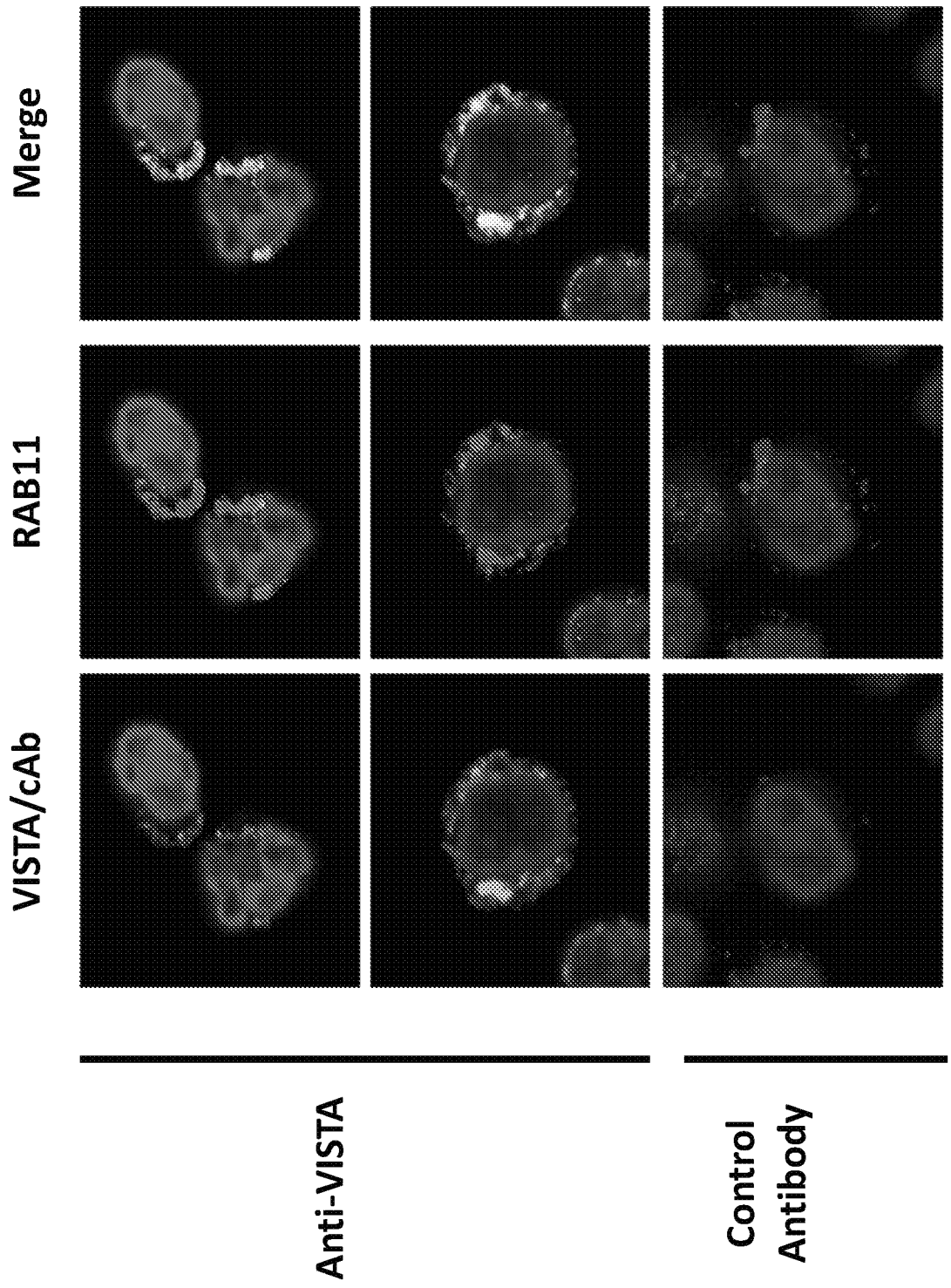

Monocytes were isolated from PBMCs by magnetic activated cell sorting. Both monocytes and 293T cells were then fixed in 4% paraformaldehyde and stained intracellularly for Rab5, Rab7 or Rab11, and with an anti-VISTA or control antibody. The control antibody ("cAb"), which is a non-VISTA-binding antibody of the same isotype as the anti-VISTA antibody, does not detectably bind monocytes or 293T cells expressing human VISTA. Anti-VISTA and control antibodies were directly labeled with Alexa488. Rab antibodies were detected using an Alexa594 anti-rabbit Ig secondary antibody. Hoescht 33342 staining was performed to identify cell nuclei. Images were captured using a spinning disk confocal microscope. FIG. 6A shows co-localization of VISTA, Rab5 (early endosome marker), Rab7 (late endosome marker), and Rab11 (recycling endosome marker) within 293T cells expressing human VISTA. FIG. 6B shows co-localization of VISTA and Rab11 within human monocytes. Intracellular VISTA is co-localized with Rab11+ recycling endosomes.

Figure 6C:
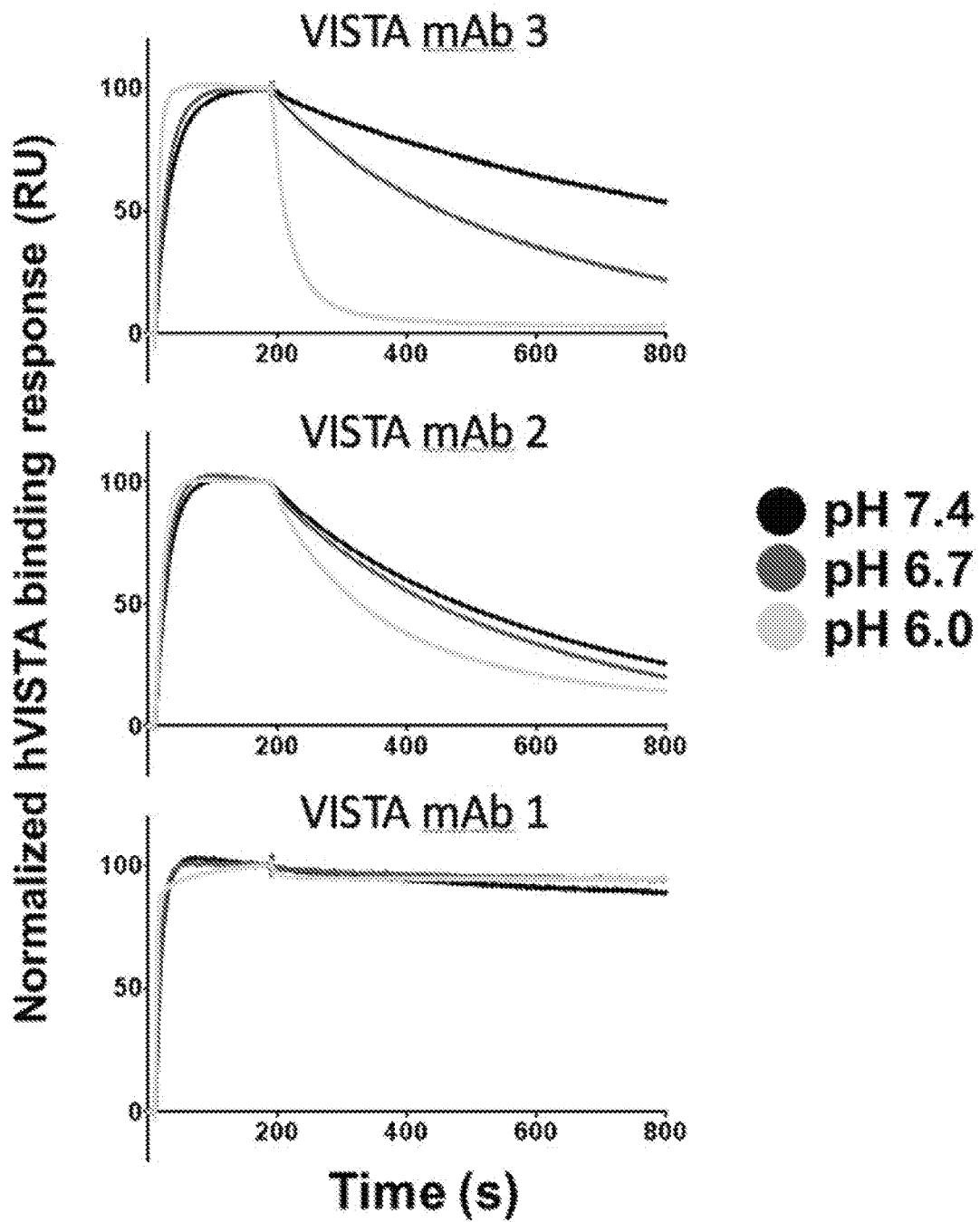

To assess VISTA's capacity to recycle through endosomes, an endolysosome-dependent antibody drug conjugate killing assay was performed with three anti-hVISTA antibodies (VISTA mAb 1, 2 and 3) with varying VISTA binding properties at physiological and acidic pH. An SPR assay was performed first to compare hVISTA binding profiles for all three VISTA antibodies at pH 7.4, 6.7 and 6.0. VISTA antibodies were captured on a Biacore® T100 (GE Healthcare) CM5 biosensor containing immobilized Protein A, then 100 nM hVISTA-ECD (amino acids 32-193 of SEQ ID NO: 1 with a 7xHis tail, i.e., AFKVATPYSL YVCPEGQNVT LTCRLLGPVD KGHDVTFYKT WYRSSRGEVQ TCSERRPIRN LTFQDLHLHH GGHQAANTSH DLAQRHGLES ASDHHGNFSI TMRNLTLLDS GLYCCLVVEI RHHHSEHRVH GAMELQVQTG KDAPSNCVVY PSSSQESENI TAHHHHHHH; SEQ ID NO: 325) was flowed in PBST running buffer at the indicated pH at 37° C. Reference-subtracted sensorgrams were normalized to the 'binding' report point and plotted. VISTA antibody 3, "mAb 3", (FIG. 6C, top) exhibited the greatest degree of VISTA binding impairment at acidic pH, followed by VISTA antibody 2, "mAb 2," (FIG. 6C, middle), which was only moderately impaired. VISTA antibody 1, "mAb 1," maintained strong VISTA binding at acidic and physiological pH conditions (FIG. 6C, bottom).

Figure 6D:
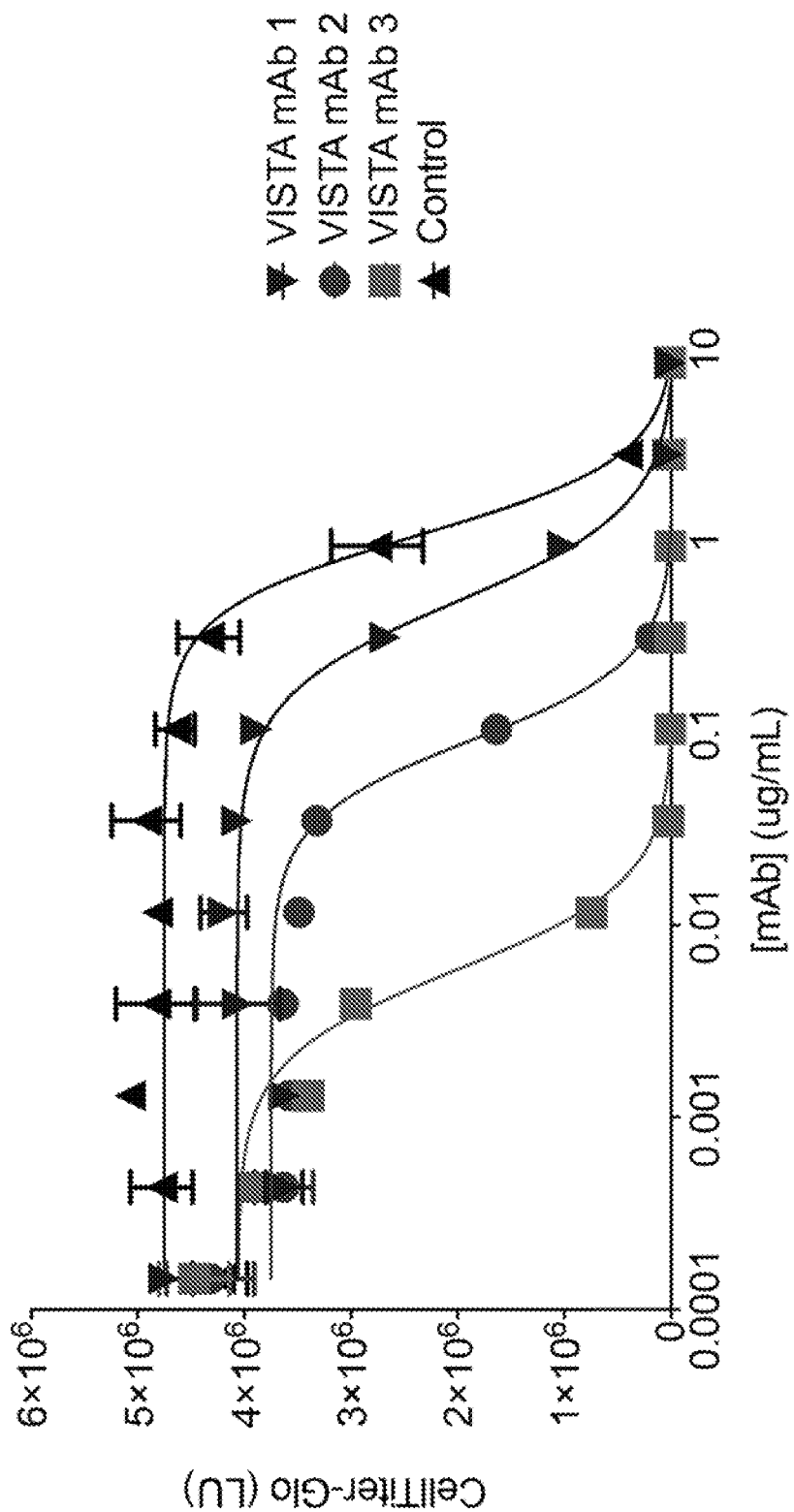

The endolysosome-dependent antibody drug conjugate killing assay was performed as follows. AML3 cells (an immortalized human monocyte cell line, ATCC CRL-9589), which endogenously express human VISTA, were cultured with titrated anti-VISTA antibodies or a non-VISTA-specific control antibody and an anti-human IgG secondary antibody that was conjugated to a cathepsin B-sensitive linker and a cytotoxic tubulysin payload. Because Cathepsin B is predominantly active in late endosomes and lysosomes, anti-VISTA antibodies that recycle with VISTA through early endosomes and recycling endosomes will experience low levels of linker cleavage and as a result low levels of the cytotoxic payload release and cell death. Anti-VISTA antibodies which become disassociated from VISTA in acidic endosomes and sorted into late endosomes and lysosomes will experience higher levels of linker cleavage. Cell viability was measured by Cell Titer Glo® (Promega catalog number G7573) after five days in culture. FIG. 6D shows the results of this assay, with AML3 viability (Cell Titer Glo) plotted on the y-axis and primary antibody concentrations plotted on the x-axis. Calculated EC50s for primary antibodies: VISTA antibody 1, inverted triangles, 0.485 μg/mL; VISTA antibody 2, circles, 0.092 μg/mL; VISTA antibody 3, squares, 0.006 μg/mL; Control, triangles, 1.085 μg/mL. Antibody potency was inversely correlated with anti-VISTA antibody binding at acidic pH.

Figure 6E:
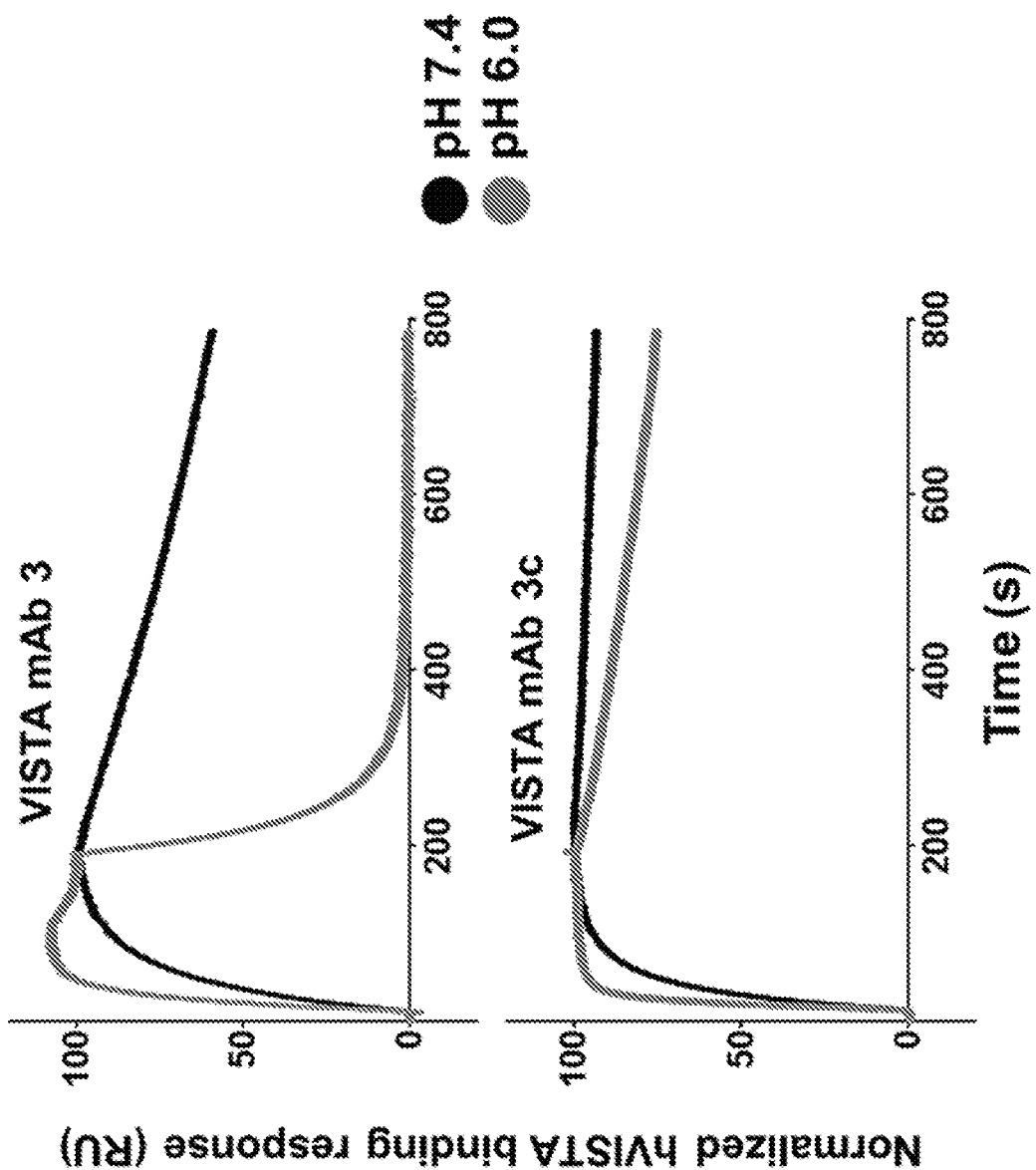
Figure 6F:
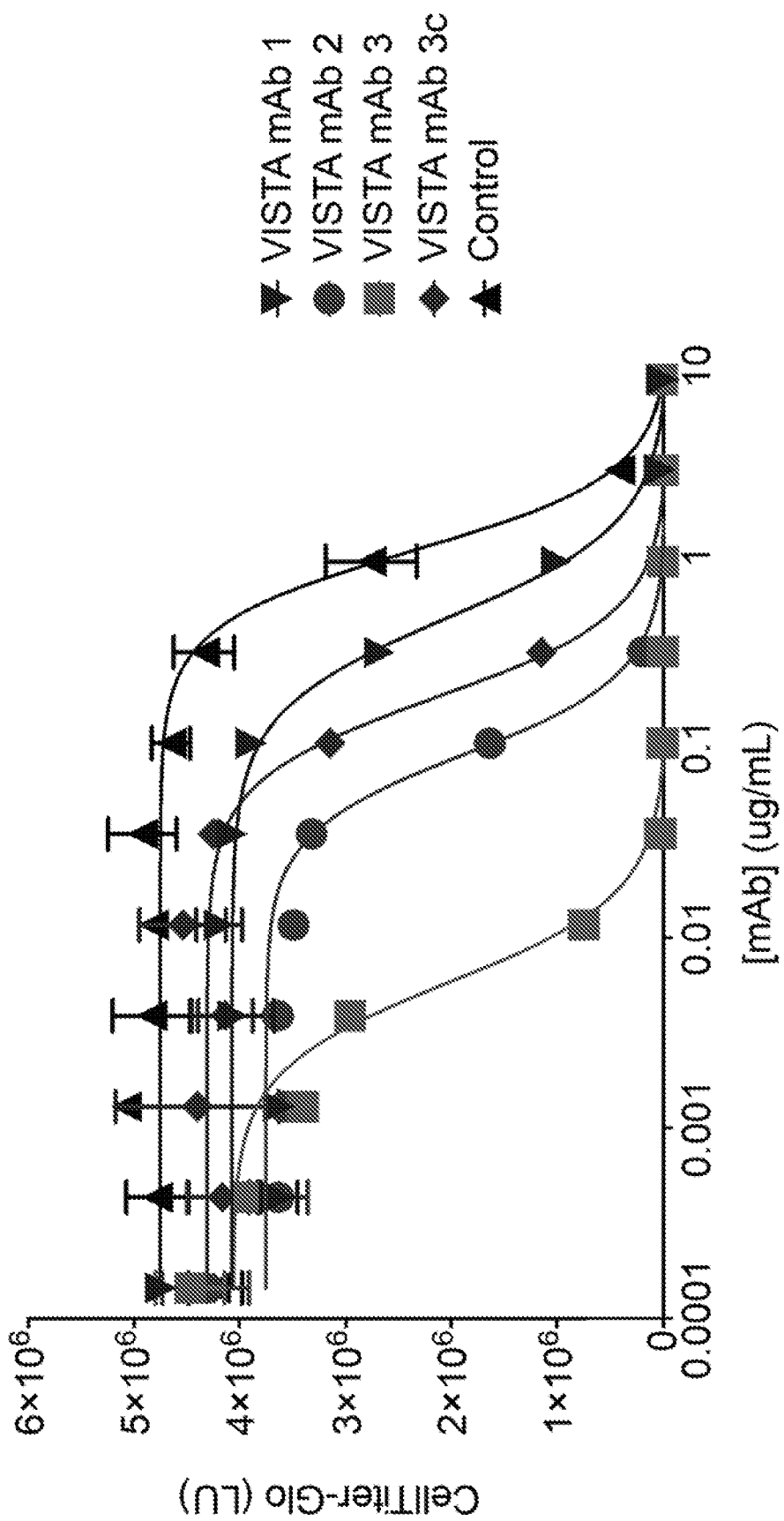

To confirm that binding at acidic pH was responsible for the differences in potency, VISTA antibody 3 was affinity optimized such that its ability to bind VISTA at acidic pH was improved. FIG. 6E shows an SPR assay comparing the hVISTA antibody binding profiles of VISTA antibody 3 with this variant, VISTA antibody 3c, using the assay conditions described for FIG. 6C. VISTA antibody 3 again exhibited VISTA binding impairment at acidic pH, whereas the variant VISTA antibody 3c exhibited comparable VISTA binding at acidic and physiological pH. FIG. 6F shows the activity of VISTA antibody 3c (diamonds) in the killing assay described for FIG. 6D. The acidic pH-optimized variant of VISTA antibody 3 exhibited a 31-fold lower potency than that of the original antibody, indicating that impaired anti-VISTA antibody binding at acidic pH results in a loss of antibody binding during VISTA recycling.

Figure 6G:
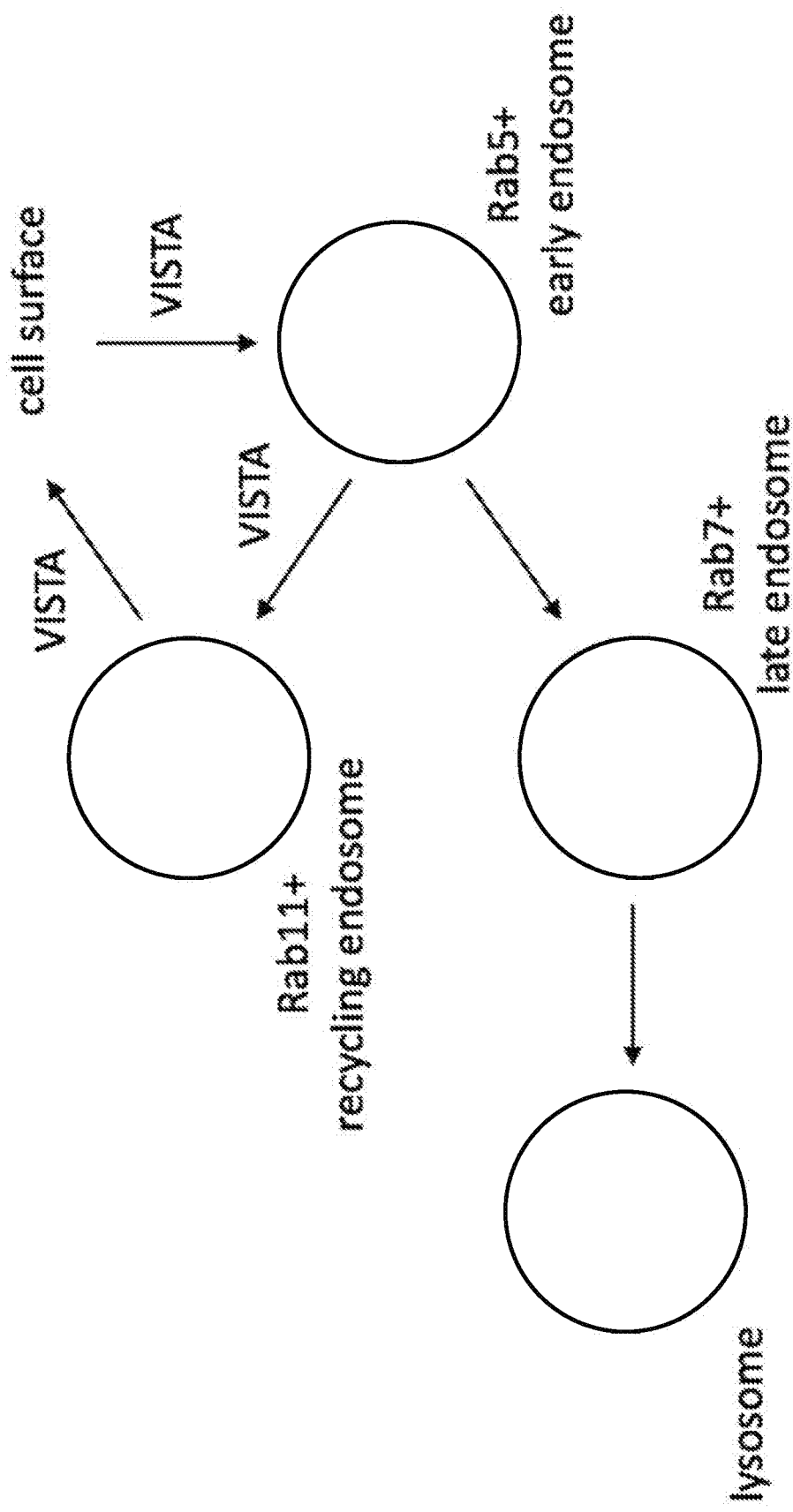

Based on these findings, a recycling model is proposed in which VISTA gets recycled to and from the cell surface via early endosomes and recycling endosomes. This model is depicted in FIG. 6G. Anti-VISTA antibodies can recycle with VISTA through these endosomes, maintaining target engagement. However, VISTA antibodies with impaired VISTA binding at acidic pH, particularly those with a fast off-rate at acidic pH, may disassociate from VISTA during recycling and become trapped or degraded inside cells, resulting in poor target engagement and continual consumption of circulating antibodies. In contrast, antibodies which bind and remain bound to VISTA at acidic pH may maintain higher levels of target engagement, particularly in acidic microenvironments such as tumors, and exhibit longer mean residence times in vivo.

Example 7: Superiority of VISTA Antibodies Lacking Binding at Physiological pH

The inventors have shown that VISTA is an acidic pH-selective immunoreceptor, demonstrating the importance and utility of targeting VISTA with antibodies that bind well at acidic pH. Additionally, antibodies that do not bind or negligibly bind to VISTA at physiological pH are advantageous for several reasons. First, due to the relatively abundant expression of VISTA on circulating myelomonocytic cells, particularly monocytes and neutrophils, antibodies that bind VISTA at physiological pH are subject to high levels of target-mediated drug disposition (TMDD) in blood. This effect is exacerbated by the propensity of VISTA to recycle through intracellular endosomes, leading to anti-VISTA antibody internalization and degradation. This secondary effect is particularly problematic for antibodies which have impaired binding at acidic pH, as can be observed for antibodies that bind VISTA's histidine-rich ligand interface. Both effects will reduce the amount of anti-VISTA antibody in circulation, reducing the amount of antibody that will reach the tumor and thus the intended biology activity of the antibody. Second, antibodies that bind VISTA at physiological pH and which possess effector functions such as induction of antibody-dependent cell cytotoxicity (ADCC), antibody-dependent cell phagocytosis (ADCP), or delivery of an immunomodulatory payload will subject circulating myelomonocytic cells to those effector functions, potentially resulting in undesirable effects such as circulating neutrophil depletion or activation. Thus, the inventors discovered that antibodies binding to huVISTA at acidic pH, but negligibly at physiological pH, have the double advantage of (1) better exposure in relevant sites such as tumors and (2) reduced toxicities in the case of antibodies with effector functions such as ADCC, ADCP, or delivery of an immunomodulatory payload. Additionally, because VISTA itself is an acidic pH-selective immunoreceptor, blockade of VISTA's ligand interface at physiological pH is likely unnecessary to modulate VISTA receptor-ligand activity. Therefore, antibodies that bind to huVISTA at acidic pH, but not significantly at physiological pH were generated as described below.

Example 8: Isolation of Anti-VISTA Antibodies Binding Preferentially to Human VISTA at Acidic pH Over Physiological pH This Example describes the generation of antibodies that bind preferentially to human VISTA at low (acidic) pH relative to neutral or physiological pH.

A library of anti-VISTA antigen binding fragments of antibodies was constructed and screened as follows. Antibody libraries were created using genetic material isolated from HuMab mice immunized with full length human VISTA (hVISTA). These antibodies were formatted as scFv and were selected against full length hVISTA binding at low pH (pH 6.0) via mRNA display (Xu L et al. (2002) *Chemistry & Biology* 9: 933; Roberts RW and JW Szostak (1997) *Proc. Natl. Acad. Sci. USA* 94:12297; Kurz et al. (2000) *Nucleic Acids Res.* 28(18): E83). Selection output was analyzed via next generation sequencing (NGS), and library members that demonstrated an enrichment to VISTA binding at low pH were identified, reformatted as IgG 1.3 (an effectorless IgG1 constant region consisting of an IgG1 Fc having amino acid mutations L234A, L235E, and G237A), and screened for binding to VISTA by SPR.

Surface plasmon resonance (SPR) analysis was performed to measure the association rates (defined as ka or $k_{on}$; 1/Ms units), dissociation rates (defined as kd or $k_{off}$, $s^{-1}$ units) and affinity constants (defined as $K_D$, M units) for VISTA Abs at acidic and physiological pHs using a Biacore® T200 instrument (GE Healthcare). Protein A (Fisher Scientific catalog #21181) was diluted to 20 µg/ml in 10 mM sodium acetate pH 4.5 and immobilized onto flow cells of a CM5 biosensor following the manufacturer's amine coupling protocol (GE Healthcare), targeting 6,000 RU immobilization density of Protein A per flow cell. SPR experiments were conducted at 37° C. using PBST (137 mM sodium chloride, 2.7 mM potassium chloride, 10 mM phosphate buffer, 0.05% Tween 20) running buffer at pH 7.4 and 6.0. Antibodies were diluted to 20 nM in PBST pH 7.4, and were captured across active biosensor flow cells at 5 ul/min for 50 seconds. A concentration series of 50-0.2 nM monovalent hVISTA-ECD (SEQ ID NO: 325) was prepared in pH 7.4 and 6.0 running buffers, and was injected over the captured antibodies at 40 ul/min to measure association and dissociation. Two 15 second injections of 10 mM glycine pH 1.5 were used to regenerate the Protein A capture surface between assay cycles. Rate constants $k_a$ ($k_{on}$) and $k_d$ ($k_{off}$) were derived from reference flow cell and 0 nM blank-subtracted sensorgrams, and were fit to a 1:1 binding model in Biacore® T200 Evaluation Software v.2.0. For each VISTA antibody, the ratio of $k_{off}$ at pH 6/$k_{off}$ at pH 7.4 was calculated to identify antibodies exhibiting slow off-rates at acidic pH and fast off-rates at physiological pH.

Six antibodies, reformatted as IgG1.3 antibodies, demonstrated near equivalent affinity at both pH 6 and pH 7.4. In particular, two antibodies had a slower off rate at pH 6.0 than at pH 7.4 (i.e., faster $k_{off}$ at pH 7.4 than pH 6.0). The variable regions of these two huVISTA antibodies are referred to as P1-061015 and P1-061029 and the antibodies comprising these variable regions and formatted as IgG1.3 antibodies are referred to as P1-061015.IgG1.3 and P1-061029.IgG1.3, respectively. The $k_{off}$ rates of P1-061015.IgG1.3 and P1-061029.IgG1.3 are provided in Table 1.

TABLE 1

$k_{off}$ of selected antibodies at pH 6.0 and pH 7.0

| Antibody name | pH 6 $k_{off}$ ($s^{-1}$) | pH 7 $k_{off}$ ($s^{-1}$) | pH 6/pH 7 $k_{off}$ |
|---|---|---|---|
| P1-061015.IgG1.3 | $1.4 \times 10^{-3}$ | $2.3 \times 10^{-3}$ | 0.6 |
| P1-061029.IgG1.3 | $4.8 \times 10^{-3}$ | $9.1 \times 10^{-3}$ | 0.5 |

The heavy and light chain CDR1, CDR2 and CDR3 sequences of P1-061015 and P1-061029 are provided in Table 2 below and are also shown in the Sequence Table following the Examples section of the disclosure.

TABLE 2

Amino acid sequences of huVISTA antibodies binding to huVISTA preferentially at pH 6.0 than pH 7.4

| P1 ID | VH-gene | VH CDR1 | VH CDR2 | VH CDR3 |
|---|---|---|---|---|
| P1-061015.IgG1.3 | 3-33 | GFTFSSYAMH (SEQ ID NO: 95 Residues 26-35) | IIWYDGSNKYYADSVKG (SEQ ID NO: 95 Residues 50-66) | DSGFYSSYYFDY (SEQ ID NO: 95 Residues 99-110) |
| P1-061029.IgG1.3 | 3-09 | GFTLDDYAMH (SEQ ID NO: 67 Residues 26-35) | GINWNSANIGYADSVKG (SEQ ID NO: 67 Residues 50-66) | VPGYSGGWIDAFDV (SEQ ID NO: 67 Residues 99-112) |

| | VL-gene | VL CDR1 | VL CDR2 | VL CDR3 |
|---|---|---|---|---|
| P1-061015.IgG1.3 | L6 | RASQSVSSSYLA (SEQ ID NO: 96 Residues 24-35) | DASNRAT (SEQ ID NO: 96 Residues 51-57) | QQYNSYPYT (SEQ ID NO: 96 Residues 90-98) |
| P1-061029.IgG1.3 | A27 | RASQSVSSSYLA (SEQ ID NO: 68 Residues 24-35) | GASSRAT (SEQ ID NO: 68 Residues 51-57) | QQYGSSPFT (SEQ ID NO: 68 Residues 90-98) |

Example 9: Further Engineering of the P1-061015 and P1-061029 Anti-VISTA Abs to Develop Acidic pH-Selective Antibodies This Example describes the further engineering of variable regions P1-061015 and P1-061029 identified in Example 2 to obtain anti-huVISTA variable regions that have a higher $k_{off}$ ratio between binding at pH 6.0 relative to pH 7.4.

Figure 7A:
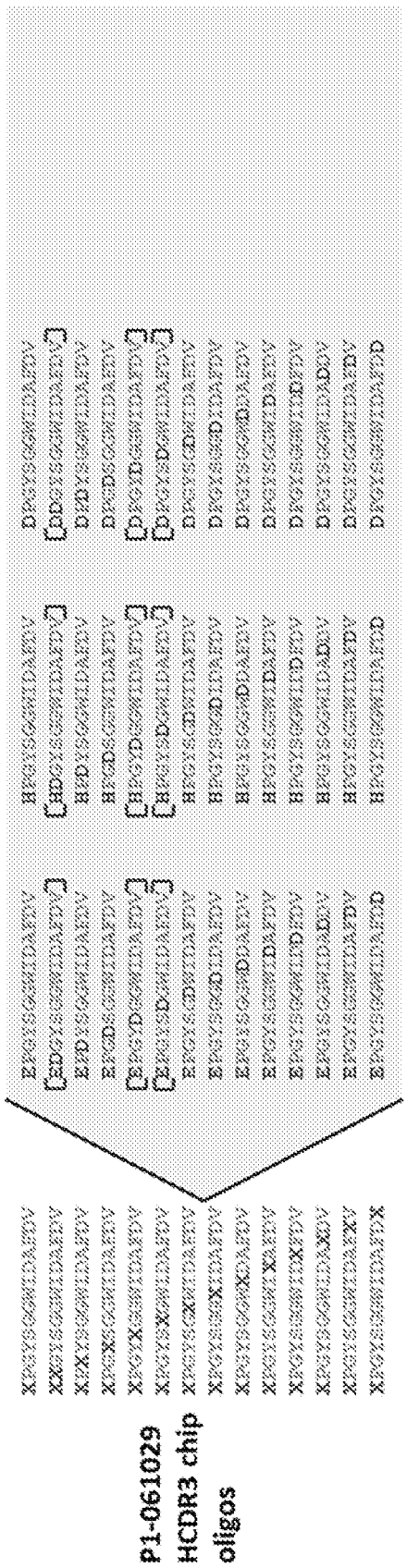
FIGS. 7A-F show how anti-VISTA antibody variant libraries were designed and screened in order to obtain acidic pH-selective antibodies.

Two libraries were built by introducing specific mutations in the VH CDRs of P1-061015 and P1-061029, respectively. The libraries allowed only for amino acid substitutions that were the most likely to improve binding at low pH, i.e., aspartate, glutamate and histidine. The library also allowed for single and double amino acid substitutions in each CDR and for recombinations across CDRs (maximum of 6 amino acid substitutions per chain). FIG. 7A shows the mutations that were introduced into the heavy chain CDR3 amino acid sequences of P1-061029 to form the P1-061029 library. The figure indicates that specific sequences were excluded to avoid introducing liabilities (e.g., DG).

Figure 7B:
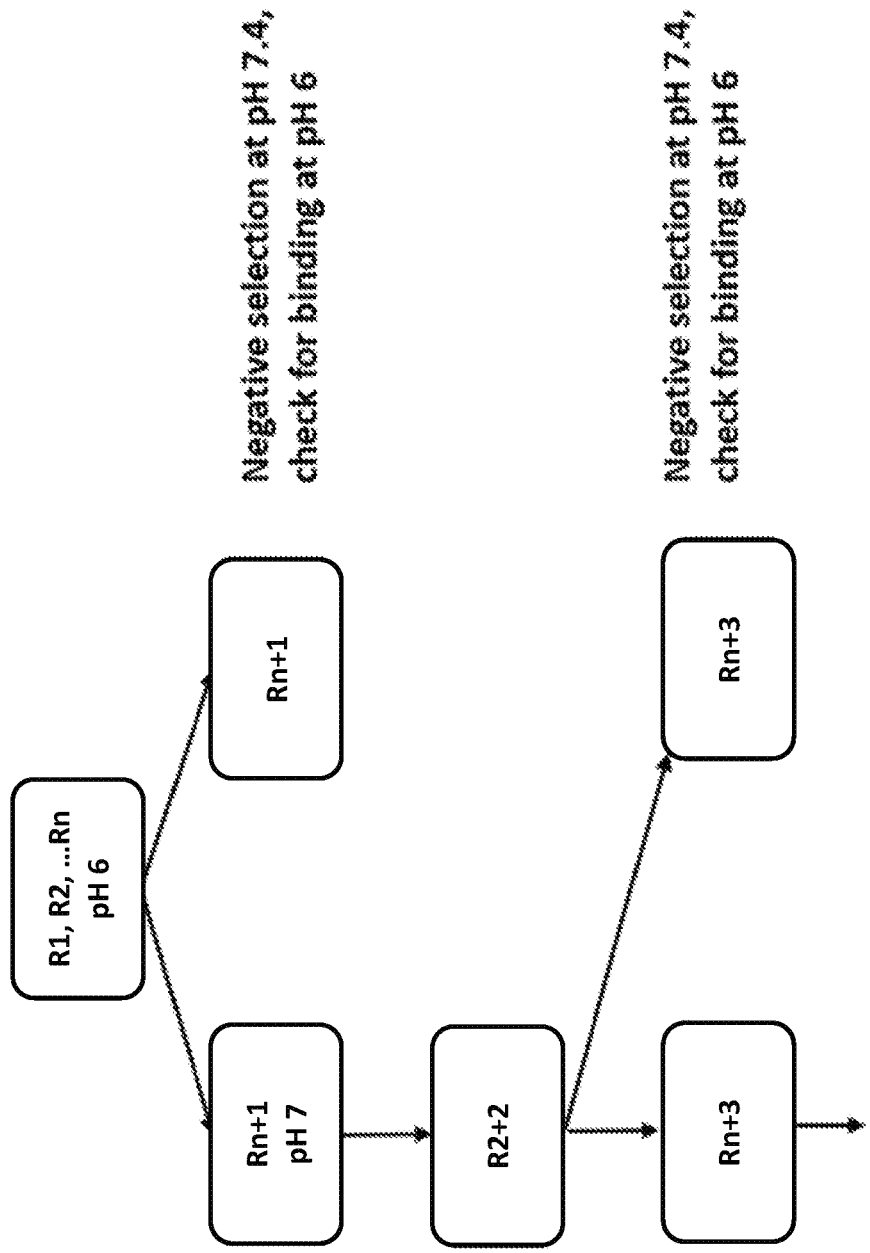
Figure 7C:
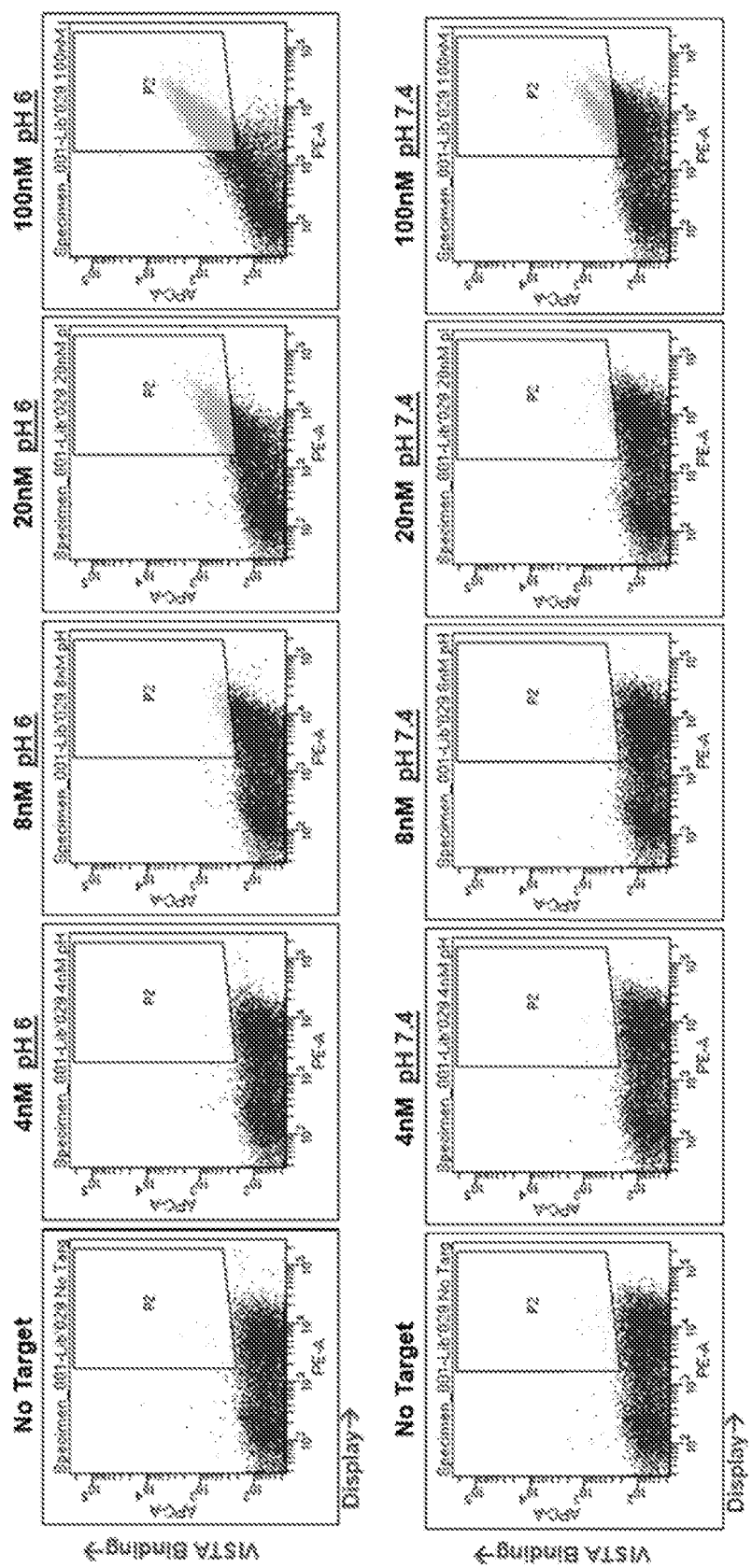

The '029 and '015 libraries were screened by several rounds of binding to full length hVISTA at pH 6.0 via yeast surface display. Further rounds of selection were conducted by toggling between positive (pH 6.0 binding to huVISTA) and negative (pH 7.4 binding to huVISTA) (shown in FIG. 7B) selections, where library members that did not bind to VISTA at pH 7.4 were collected in the negative selection rounds. The selection output was analyzed by NGS. The '029 library members that bound to huVISTA at pH 6.0 after round 9 of selection were analyzed for binding to human VISTA at pH 6.0 and pH 7.4 via flow cytometry. FIG. 7C shows representative two-dimensional flow cytometry plots showing the variant pool after 9 rounds of selection. VISTA binding is plotted on the y-axis, and variant antibody expression is plotted on the x-axis. Binding data at various antibody concentrations and pH are shown. The results demonstrated very strong pH 6-selective binding to human VISTA, particularly at 20 nM.

Additional progeny clones of the '029 were isolated from the '029 library using a different method. Some clones were the same as those identified by the first method, and nine additional clones were isolated.

The 19 clones isolated from the '029 library selected for further analysis were reformatted as IgG1.3 antibodies. The amino acid differences in the heavy chain CDRs of these clones relative to those of the '029 VH CDRs are shown in Table 5.

Binding of several preparations of each of the '029 progeny clones and of the parent '029 antibodies, formatted as IgG1.3 antibodies, to human VISTA at pH 6.0 and 7.4 was measured by Surface plasmon resonance (SPR). SPR analysis was performed to measure $k_{off}$ and $K_D$ binding affinity measurements for VISTA Abs at acidic and neutral pHs using a Biacore® T100 instrument (GE Healthcare). Protein A (ThermoFisher Scientific catalog #21181) was diluted to 20 µg/ml in 10 mM sodium acetate pH 4.5 and immobilized onto flow cells of a CM5 biosensor following the manufacturer's amine coupling protocol (GE Healthcare), targeting 2,000 RU immobilization density of Protein A per flow cell. SPR experiments were conducted at 37° C. using PBST (137 mM sodium chloride, 2.7 mM potassium chloride, 10 mM phosphate buffer, 0.05% Tween® 20) running buffer at pH 7.4 and 6.0. Antibodies were diluted to 25 nM in PBST pH 7.4, and were captured across active biosensor flow cells at 5 ul/min for 60 seconds. A concentration series of 50-5 nM monovalent hVISTA-ECD (SEQ ID NO: 325) was prepared in pH 7.4 and 6.0 running buffers, and was injected over the captured antibodies at 40 ul/min to measure association and dissociation. Two 15 second injections of 10 mM glycine pH 1.5 were used to regenerate the Protein A capture surface between assay cycles. Rate constants ka ($k_{on}$) and kd ($k_{off}$)

TABLE 5

VH CDR1, CDR2 and CDR3 amino acid sequences (separated by an underscore) of antibodies derived from the '029 parent antibody

| NAME | CDR1 (pos 26-35) | CDR2 (pos 50-66) | CDR3 (pos 99-110) | SEQ ID NO |
|---|---|---|---|---|
| P1-061029 | GFTLDDYAMH | GINWNSANIGYADSVKG | VPGYSGGWIDAFDV | 67 |
| P1-068757 | ----E-E--- | ------EE--------- | -----------E-D | 71 |
| P1-068759 | ----E-E--- | --D---E--------- | -----------E-D | 87 |
| P1-068761 | ----E-E--- | ------EE--------- | -----H-----E-- | 51 |
| P1-068763 | ----E----- | --D---E--------- | -----H-----E-- | 91 |
| P1-068765 | ---DE----- | ------EE--------- | -----------E-D | 63 |
| P1-068767 | ----E----- | --D---E--------- | -----------E-D | 55 |
| P1-068769 | ----E-E--- | ------DH--------- | -----------E-D | 83 |
| P1-068771 | ----E-E--- | ------HE--------- | -----------E-D | 75 |
| P1-068773 | ----E----- | --D---D--------- | -----------E-D | 59 |
| P1-068775 | ----E-E--- | --D---EE--------- | -----H-----E-D | 79 |
| P1-069059 | ----E----- | ------DH--------- | -----------E-D | 11 |
| P1-069061 | ----E----- | -------E--------- | -----------E-D | 15 |
| P1-069063 | ----E----- | -------E--------- | -----------D-E | 19 |
| P1-069065 | ----E-E--- | ------DD--------- | -------------- | 23 |
| P1-069067 | ---------- | ------EE--------- | -----------D-E | 27 |
| P1-069069 | ---------- | ------EE--------- | -----------D-- | 31 |
| P1-069071 | ----E-E--- | -------D--------- | -----E-------- | 35 |
| P1-069073 | ----E----- | --D---D--------- | -----------E-D | 39 |
| P1-069075 | ----E----- | ----D--E--------- | -----H-----E-- | 43 |
| P1-069077 | ----E-E--- | ------DE--------- | -------------- | 47 | were derived from reference flow cell and 0 nM blank-subtracted sensorgrams, and were fit to a 1:1 binding model in Biacore® T200 Evaluation Software v.2.0. The affinity constant, $K_D$ was calculated as the ratio of rate constants $k_{off}/k_{on}$ for each VISTA antibody.

Figure 7D:
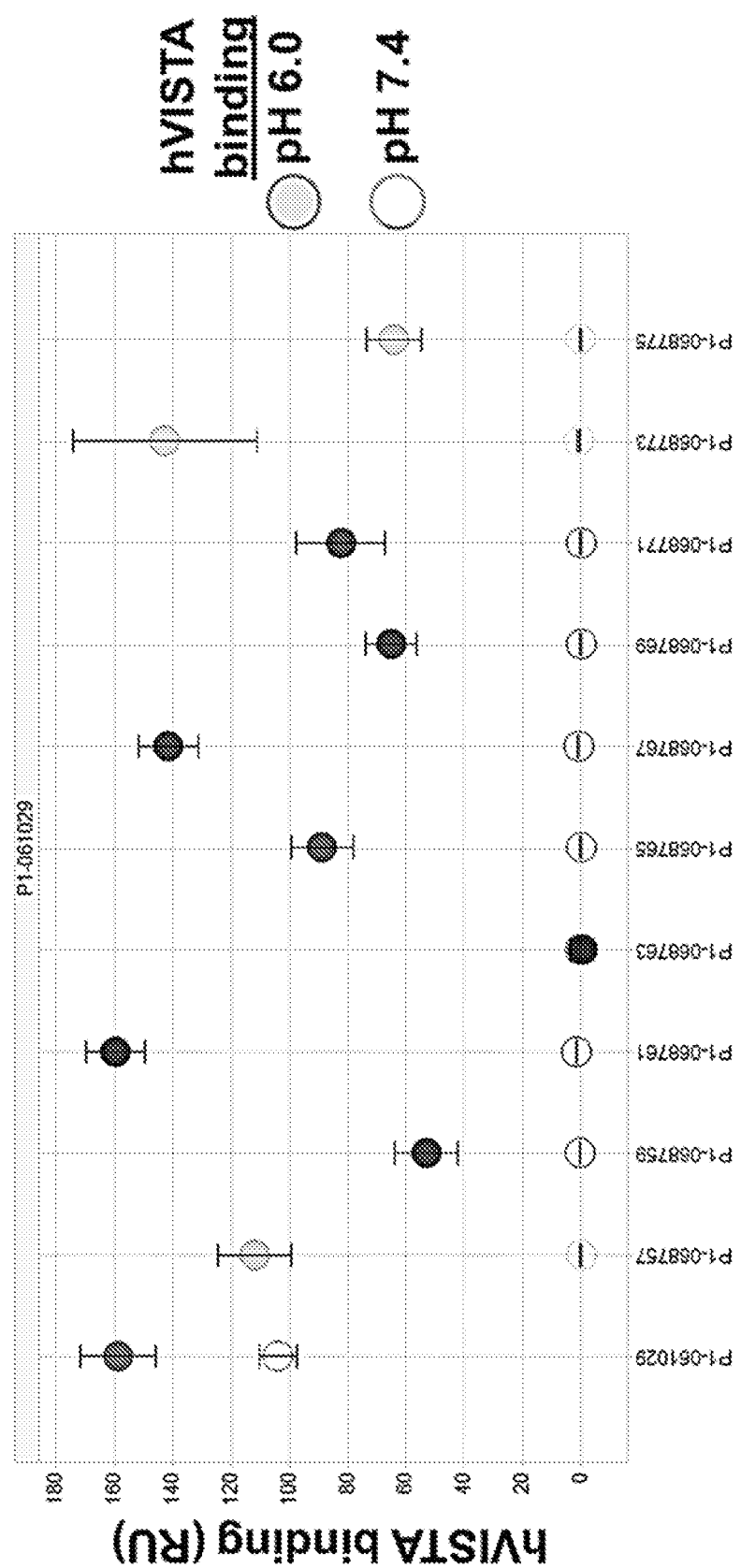

The maximal (or magnitude) human VISTA binding response is defined as the reference-subtracted 'binding' report point response at the end of the 50 nM VISTA injection for each antibody, and is reported in response units (RUs). The maximal human VISTA binding response (RUs) to each antibody is plotted in FIG. 7D. The mean average binding response (between two to four replicate antibodies) is plotted, and error bars represent the standard deviation. The results indicate that the selected progeny clones of '029 bind to hVISTA at pH 6.0, but not at pH 7.4 (empty circles representing binding at pH 7.4 are all located at the bottom of the graph except for the parent '029 clone).

Figure 7E:
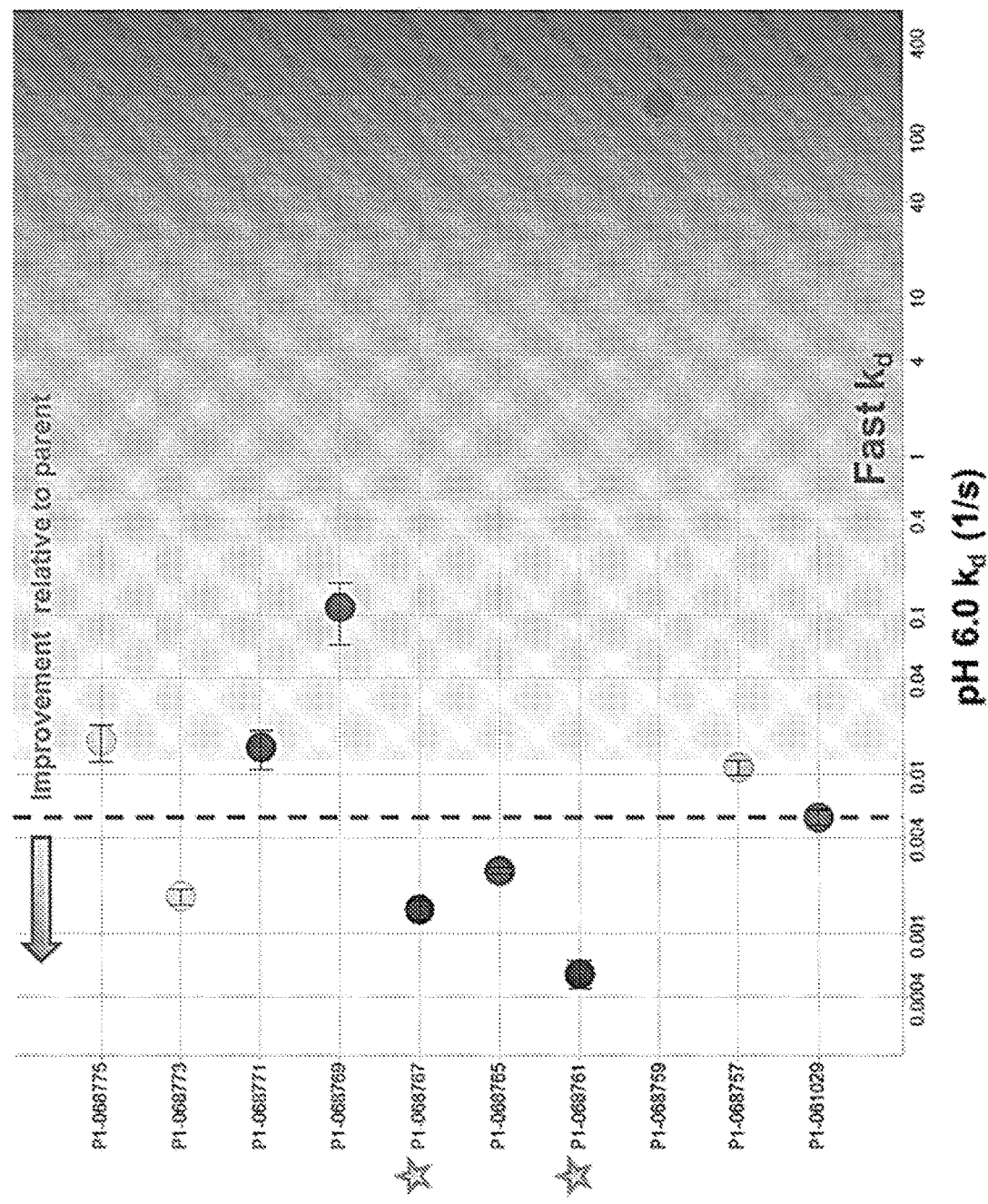

The $k_{off}$ rates at pH 6.0 of the '029 and its progeny was determined by SPR using the method described above, and are represented in FIG. 7E. The dashed line in the figure represent the $k_{off}$ rate of '029, and clones to the left of the dashed line have a slower $k_{off}$ rate at pH 6.0 relative to that of the parental '029 antibody, whereas those on the right side have a faster $k_{off}$ rate at pH 6.0 relative to that of the parental '029 antibody.

Figure 7F:
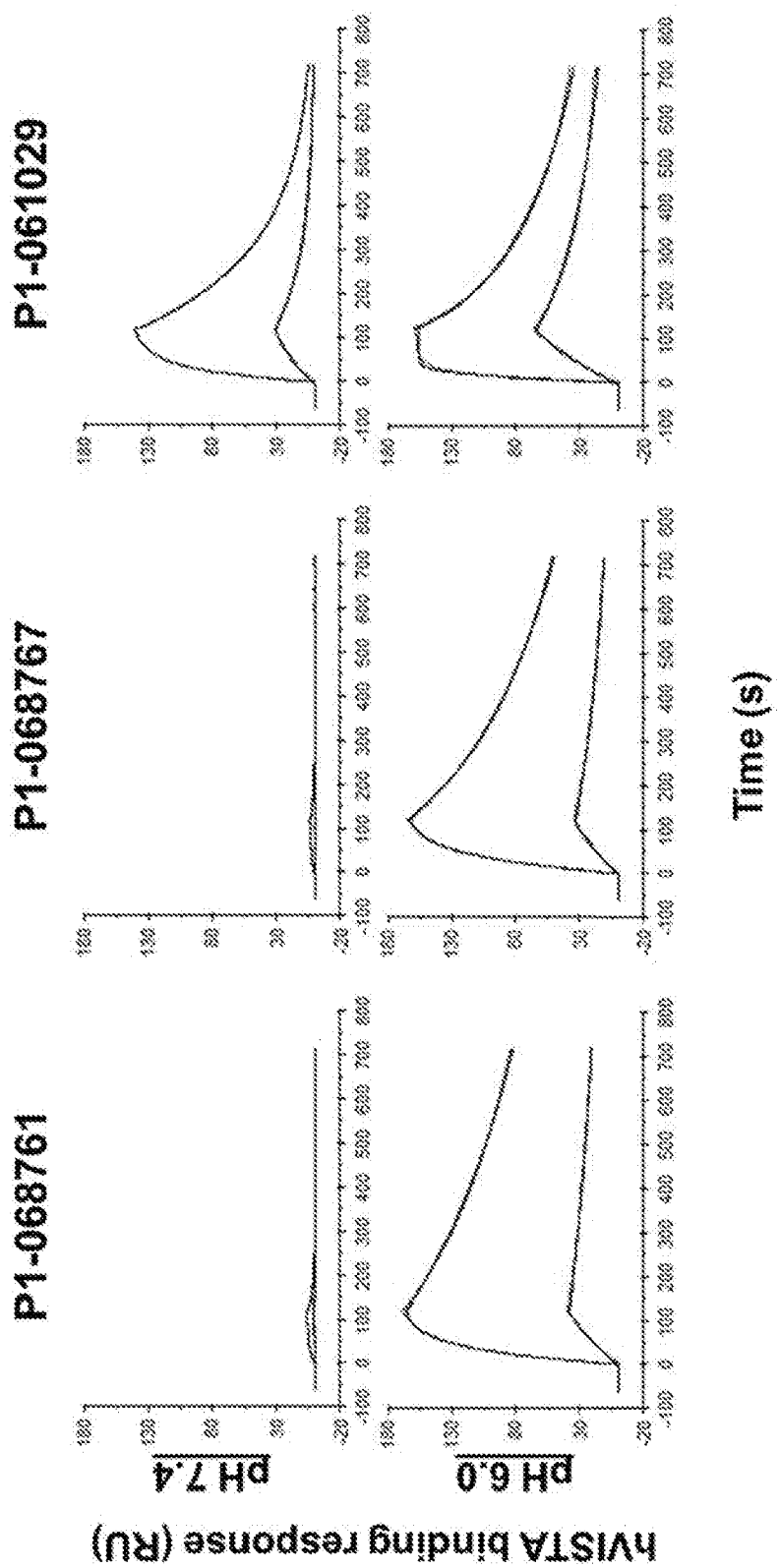

Representative hVISTA SPR binding sensorgrams to the '029, '761 and '767 antibodies at neutral and acidic pH are shown in FIG. 7F. Reference-subtracted 50 nM and 5 nM huVISTA sensorgrams are plotted. At neutral pH, <10 RU VISTA binding signal was observed for '761 and '767, thus in order to adequately measure and compare the $k_{off}$ and $K_D$ for '761 and '767 to '029, a SPR kinetics assay utilizing M VISTA concentrations at physiological pH was required.

For this assay, '029, '761 and '767 were reformatted as hIgG1f isotype and were expressed as both standard hIgG1f and in hIgG1f afucosylated formats to compare against the hIgG1.3f Fc. An SPR kinetics assay was conducted to measure $k_{off}$ and $K_D$ binding affinity measurements for VISTA Abs at acidic and physiological pH using a Biacore® T100 instrument (GE Healthcare). Protein A (ThermoFisher Scientific catalog #21181) was diluted to 20 µg/ml in 10 mM sodium acetate pH 4.5 and immobilized onto flow cells of a CM5 biosensor following the manufacturer's amine coupling protocol (GE Healthcare), targeting 2,000 RU immobilization density of Protein A per flow cell. SPR experiments were conducted at 37° C. using PBST (137 mM sodium chloride, 2.7 mM potassium chloride, 10 mM phosphate buffer, 0.05% Tween 20) running buffer at pH 7.4 and 6.0. Antibodies were diluted to 25 nM in PBST pH 7.4, and were captured across active biosensor flow cells at 5 ul/min for 45 seconds. A concentration series of 1600-0.78 nM (pH 7.4) and 100-0.78 nM (pH 6.0) monovalent hVISTA-ECD (SEQ ID NO: 325) was prepared running buffer, and was injected over the captured antibodies at 40 ul/min to measure association and dissociation. Two 15 second injections of 10 mM glycine pH 1.5 were used to regenerate the Protein A capture surface between assay cycles. Rate constants ka ($k_{on}$) and $k_d$ ($k_{off}$) were derived from reference flow cell and 0 nM blank-subtracted sensorgrams, and were fit to a 1:1 binding model in Biacore® T200 Evaluation Software v.2.0. The affinity constant, $K_D$ was calculated as the ratio of rate constants $k_{off}/k_{on}$ for each VISTA antibody. Ratios of $k_{off}$ and $K_D$ at pH 7.4/pH 6.0 were calculated to compare off-rate and affinity improvement at acidic pH relative to physiological pH. While the neutral pH binding rate constants were not previously able to be determined for '761 and '767 using 50 nM hVISTA (FIGS. 7D and 7F), increasing the neutral pH VISTA concentration range to 1.6 µM resulted in binding responses (>10 RU) for these clones that fit to a 1:1 binding model. Kinetic data for these acidic-selective VISTA antibodies is shown in Table 6. The '029 parent exhibits equivalent $k_{off}$ at both pHs, while '761 and '767 exhibit over 10-fold selectivity for pH 6 over pH 7.4 in $k_{off}$ and over 2000-fold selectivity for pH 6 over pH 7.4 in $K_D$. Human VISTA binding rate constants are conserved across hIgG1.3f, hIgG1f and afucosylated hIgG1f isotype variants.

TABLE 6

Binding characteristics of VISTA antibodies as determined by SPR

| Antibody | Isotype | pH 7.4 ka (1/Ms) | pH 7.4 kd (1/s) | pH 7.4 KD (M) | pH 6.0 ka (1/Ms) |
|---|---|---|---|---|---|
| P1-061029 | hIgG1.3f | 1.6E+05 | 6.8E-03 | 4.2E-08 | 1.1E+06 |
| | hIgG1f | 1.7E+05 | 7.4E-03 | 4.2E-08 | 1.1E+06 |
| | hIgG1f afucosylated | 1.7E+05 | 7.2E-03 | 4.1E-08 | 1.1E+06 |
| P1-068761 | hIgG1.3f | 3.8E+03 | 4.2E-02 | 1.1E-05 | 3.7E+05 |
| | hIgG1f | 1.2E+03 | 4.2E-02 | 3.5E-05 | 3.6E+05 |
| | hIgG1f afucosylated | 5.1E+03 | 4.2E-02 | 8.2E-06 | 3.7E+05 |
| P1-068767 | hIgG1.3f | 1.9E+03 | 3.6E-02 | 1.9E-05 | 3.3E+05 |
| | hIgG1f | 1.5E+03 | 3.2E-02 | 2.2E-05 | 3.2E+05 |
| | hIgG1f afucosylated | 1.3E+03 | 3.3E-02 | 2.4E-05 | 3.3E+05 |
| α-VISTA acidic pH sensitive | hIgG1.3f | 2.2E+05 | 7.8E-04 | 3.6E-09 | 2.8E+06 |

| Antibody | pH 6.0 kd (1/s) | pH 6.0 KD (M) | kd ratio (7.4/6) | KD ratio (7.4/6) |
|---|---|---|---|---|
| P1-061029 | 7.9E-03 | 7.2E-09 | 0.9 | 5.8 |
| | 8.0E-03 | 7.1E-09 | 0.9 | 5.9 |
| | 7.8E-03 | 6.9E-09 | 0.9 | 5.9 |
| P1-068761 | 1.6E-03 | 4.3E-09 | 26.3 | 2558.1 |
| | 1.5E-03 | 4.2E-09 | 28.0 | 8333.3 |
| | 1.5E-03 | 4.1E-09 | 28.0 | 2000.0 |
| P1-068767 | 2.6E-03 | 7.8E-09 | 13.8 | 2435.9 |
| | 2.6E-03 | 8.0E-09 | 12.3 | 2750.0 |
| | 2.6E-03 | 7.9E-09 | 12.7 | 3038.0 |
| α-VISTA acidic pH sensitive | 9.0E-02 | 3.2E-08 | 0.01 | 0.1 |

Human VISTA binding kinetics of P1-061029 ("029"), P1-068761 ("761") and P1-068767 ("767") (as IgG1.3 antibodies) were measured at pH values between pH 7.4 and pH 6.0, i.e., at pH 6.9 and pH 6.45 using a Biacore® T100 instrument (GE Healthcare). Protein A (ThermoFisher Scientific catalog #21181) was diluted to 20 µg/ml in 10 mM sodium acetate pH 4.5 and immobilized onto flow cells of a CM5 biosensor following the manufacturer's amine coupling protocol (GE Healthcare), targeting 2,000 RU immobilization density of Protein A per flow cell. The assay was conducted at 37° C. using PBST (137 mM sodium chloride, 2.7 mM potassium chloride, 10 mM phosphate buffer, 0.05% Tween 20) running buffer at pH 7.4, 6.9, 6.45 and 6.0. Antibodies were diluted to 25 nM in PBST pH 7.4, and were captured across active biosensor flow cells at 5 ul/min for 45 seconds. A concentration series of 100-0.78 nM monovalent hVISTA-ECD (SEQ ID NO: 325) was prepared pH 7.4, 6.9, 6.45 and 6.0 running buffers, and was injected over the captured antibodies at 40 ul/min to measure association and dissociation. Two 15 second injections of 10 mM glycine pH 1.5 were used to regenerate the Protein A capture surface between assay cycles. Rate constants ka (k) and $k_d$ ($k_{off}$) were derived from reference flow cell and 0 nM blank-subtracted sensorgrams, and were fit to a 1:1 binding model in Biacore® T200 Evaluation Software v.2.0. The affinity constant, $K_D$ was calculated as the ratio of rate constants $k_{off}/k_{on}$ for each VISTA antibody. Ratios of $k_{off}$ and $K_D$ at each pH relative to pH 6.0 were calculated to evaluate how the VISTA $k_{off}$ and $K_D$ change as the buffer pH shifts to physiological, and are shown in Table 7. The '029 parent exhibited consistent $k_{off}$ at each pH tested, while the '761 and '767 progeny exhibited at least 10-fold faster VISTA $k_{off}$ and 100-fold weaker VISTA $K_D$ at pH 6.9 compared to pH 6.0. As the buffer pH shifts from acidic to physiological, VISTA $k_{off}$ and $K_D$ both weaken for '761 and '767. Physiological pH data for '761 and '767 for comparison is referenced from Table 7 and noted with an asterisk (*).

TABLE 7

Kinetic binding characteristics of '029, '761 and '767 antibodies at different pH values

| Antibody | pH | ka (1/Ms) | kd (1/s) | KD (M) | koff ratio to pH 6.0 | KD ratio to pH 6.0 |
|---|---|---|---|---|---|---|
| P1-061029 (parent) | 6.0 | 2.9E+06 | 5.7E−03 | 2.0E−09 | 1.0 | 1.0 |
| | 6.45 | 7.4E+05 | 4.0E−03 | 5.3E−09 | 0.7 | 2.7 |
| | 6.9 | 4.1E+05 | 5.7E−03 | 1.4E−08 | 1.0 | 7.1 |
| | 7.4 * | 2.5E+05 | 6.4E−03 | 2.6E−08 | 1.1 | 13.2 |
| P1-068761 | 6.0 | 6.0E+05 | 6.6E−04 | 1.1E−09 | 1.0 | 1.0 |
| | 6.45 | 1.1E+05 | 2.1E−03 | 2.0E−08 | 3.2 | 18.4 |
| | 6.9 | 4.8E+04 | 8.9E−03 | 1.9E−07 | 13.4 | 170 |
| | 7.4 * | 3.8E+03 | 4.2E−02 | 1.1E−05 | ~63.6 | ~10000 |
| P1-068768 | 6.0 | 5.6E+05 | 1.9E−03 | 3.4E−09 | 1.0 | 1.0 |
| | 6.45 | 1.3E+05 | 4.8E−03 | 3.8E−08 | 2.5 | 11.0 |
| | 6.9 | 7.4E+04 | 2.9E−02 | 4.0E−07 | 15.3 | 115.1 |
| | 7.4 * | 1.9E+03 | 3.6E−02 | 1.9E−05 | ~19.0 | ~5000 |

The data in Table 7 indicates that an at least 10 fold lower affinity of binding of '761 and '767 to hVISTA at pH 6.45 compared to pH 6.0; an at least 100 fold lower affinity of binding of '761 and '767 to hVISTA at pH 6.9 compared to pH 6.0; and an at least 1000 fold lower affinity of binding of '761 and '767 to hVISTA at pH 7.4 compared to pH 6.0.

The '015 library also demonstrated a slight preference for pH 6-selective binding to VISTA. The amino acid differences of the progeny clones relative to the '015 VH CDRs is shown in Table 8. Binding of several preparations of each of the '015 progeny clones and of the parent '015 (all as IgG1.3 antibodies) to human VISTA at pH 6.0 and 7.4 was measured via SPR using the identical method described for the '029 analysis above, and is shown in Table 8.

TABLE 8

VH CDR1, CDR2 and CDR3 amino acid sequences of antibodies (separated by underscore) derived from the '015 parent antibody

| NAME | CDR1 (pos 26-35) | CDR2 (pos 50-66) | CDR3 (pos 99-110) | SEQ ID NO |
|---|---|---|---|---|
| P1-061015 | GFTFSSYAMH | IIWYDGSNKYYADSVKG | DSGFYSSYYFDY | 95 |
| P1-068736 | -----E----_-D | --------D-------_ | -----D-----D | 107 |
| P1-068738 | -----E--H-_---D | ----H--------_ | -----ED----- | 131 |
| P1-068740 | -----D----_ | -------D-D-------_ | -----D-----D | 115 |
| P1-068742 | -----D----_ | -------D-D-------_ | -----ED----- | 119 |
| P1-068744 | -----E----_H | ---------E-------_ | -----E-----E | 103 |
| P1-068746 | ----------_ | --------HH-------_ | -----D------ | 123 |
| P1-068748 | -----HH---_ | --------DD-------_ | -----D------ | 99 |
| P1-068750 | -----D-D--_E--D | -------------_EE | --------- | 127 |
| P1-068752 | ----------_E | --------D-------_ | -----D-----E | 111 |
| P1-068754 | -----D-D--_E--D | -------------_ | ----H-D----- | 135 |

A summary of the kinetics of binding of '029 and '015 and their progeny clones to huVISTA at pH 6.0 and 7.4, as determined by SPR, is shown in Tables 9 and 10.

TABLE 9 huVISTA kinetics summary and VH CDR sequences of the '029 clone and their progeny

| ID | Avg 7.4 ka (1/Ms) | Avg 7.4 kd (1/s) | Avg 7.4 KD (M) | Avg 6.0 ka (1/Ms) | Avg 6.0 kd (1/s) | Avg 6.0 KD (M) | VH CDR 1 (pos 26-35) | VH CDR 2 (pos 50-66) | VH CDR 3 (pos 99-110) | SEQ ID NO |
|---|---|---|---|---|---|---|---|---|---|---|
| P1-069077 | 6.0E+04 | 1.9E-03 | 3.1E-08 | 6.3E+05 | 1.2E-04 | 1.9E-10 | ....E.E... | ......DE......... | ............... | 47 |
| P1-069065 | 5.9E+04 | 2.3E-03 | 3.9E-08 | 5.7E+05 | 2.2E-04 | 3.8E-10 | ....E.E... | ......DD......... | ............... | 23 |
| P1-069075 | 1.3E+05 | 2.3E-03 | 1.8E-08 | 1.3E+06 | 2.9E-04 | 2.2E-10 | ....E..... | ....D..E......... | .....H.....E.. | 43 |
| P1-069071 | 4.3E+04 | 4.0E-03 | 9.3E-08 | 7.0E+05 | 5.1E-04 | 7.3E-10 | ....E.E... | .......D......... | .......E....DV | 35 |
| P1-069061 | Weak, fast kd | | | 4.3E+05 | 1.1E-03 | 2.5E-09 | ....E..... | .......E......... | ..........E.D | 15 |
| P1-069069 | 9.0E+04 | 7.5E-03 | 8.4E-08 | 1.4E+06 | 1.2E-03 | 8.6E-10 | .......... | ......EE......... | ...........D.. | 31 |
| P1-068761 | Weak, fast kd | | | 3.8E+05 | 1.4E-03 | 3.8E-09 | ....E.E... | ......EE......... | .....H.....E.. | 51 |
| P1-069059 | Weak, fast kd | | | 3.4E+05 | 1.6E-03 | 4.8E-09 | ....E..... | ......DH......... | ..........E.D | 11 |
| P1-068767 | Weak, fast kd | | | 3.4E+05 | 2.6E-03 | 7.6E-09 | ....E..... | ..D...E.......... | ..........E.D | 55 |
| P1-068773 | Weak, fast kd | | | 3.0E+05 | 2.9E-03 | 9.4E-09 | ....E..... | ..D...D.......... | ..........E.D | 59 |
| P1-069063 | 1.2E+05 | 2.7E-02 | 2.3E-07 | 1.9E+06 | 4.4E-03 | 2.4E-09 | ....E..... | .......E......... | ..........D.E | 19 |
| P1-069067 | 1.0E+05 | 2.7E-02 | 2.9E-07 | 1.7E+06 | 4.5E-03 | 2.7E-09 | .......... | ......EE......... | ..........D.E | 27 |
| P1-069073 | Weak, fast kd | | | 6.1E+05 | 5.8E-03 | 9.4E-09 | ....E.E... | .......E......... | ...........E.. | 39 |
| P1-061029 | 2.9E+05 | 5.6E-03 | 1.9E-08 | 1.6E+06 | 5.8E-03 | 3.6E-09 | GFTLDDYAMH | GINWNSANIGYADSVKG | VPGYSGGWIDAFDV | 67 |
| P1-068765 | No binding | | | 3.7E+05 | 7.0E-03 | 1.9E-08 | ...DE..... | ......EE......... | ..........E.D | 63 |
| P1-068757 | No binding | | | 8.9E+05 | 1.7E-02 | 1.9E-08 | ....E.E... | ......EE......... | ..........E.D | 71 |
| P1-068771 | No binding | | | 7.6E+05 | 1.8E-02 | 2.5E-08 | ....E.E... | ......HE......... | ..........E.D | 75 |
| P1-068769 | No binding | | | 8.1E+05 | 4.0E-02 | 5.5E-08 | ....E.E... | ......DH......... | ..........E.D | 83 |
| P1-068775 | No binding | | | 1.8E+06 | 4.7E-02 | 2.3E-08 | ....E.E... | ..D...EE......... | .....H.....E.D | 79 |
| P1-068759 | No binding | | | 1.3E+06 | 8.0E-02 | 6.0E-08 | ....E.E... | ..D...E........... | ..........E.D | 87 |

TABLE 10 huVISTA kinetics summary and VH CDR sequences of the '015 clone and their progeny

| Clone | Avg 7.4 ka (1/Ms) | Avg 7.4 kd (1/s) | Avg 7.4 KD (M) | Avg 6.0 ka (1/Ms) | Avg 6.0 kd (1/s) | Avg 6.0 KD (M) | HCDR Sequence (pos 26-35) | (pos 50-66) | (pos 99-110) | SEQ ID NO |
|---|---|---|---|---|---|---|---|---|---|---|
| P1-061015 | 2.3E+05 | 2.0E-03 | 8.8E-09 | 1.8E+06 | 9.5E-04 | 5.4E-10 | GFTFSSYAMH | IIWYDGSNKYYADSVKG | DSGFYSSYYFDY | 95 |
| P1-068748 | No binding | | | 1.4E+06 | 1.5E-03 | 1.0E-09 | .....HH... | ._........DD | ......._..... | 99 |
| | | | | | | | D...... | | | |
| P1-068744 | | | | 1.3E+06 | 1.8E-03 | 1.3E-09 | .....E.... | _H.........E | ......._..... | 103 |
| | | | | | | | E.....E | | | |
| P1-068736 | | | | 8.4E+06 | 9.5E-03 | 1.1E-09 | .....E...._ | .D.......D | ......._..... | 107 |
| | | | | | | | D.....D | | | |
| P1-068752 | | | | 6.1E+06 | 3.4E-02 | 5.6E-09 | ........._ | E........D | ......._..... | 111 |
| | | | | | | | D.....E | | | |
| P1-068740 | | | | Too fast | 4.7E-02 | ND | .....D...._ | ........D.D | ......._..... | 115 |
| | | | | | | | D.....D | | | |
| P1-068742 | | | | Too fast | >1E-02 | ND | .....D...._ | ........D.D | ......._..... | 119 |
| | | | | | | | ED..... | | | |
| P1-068746 | | | | Too fast | >1E-02 | ND | ........._ | ........HH | ......._..... | 123 |
| | | | | | | | D...... | | | |
| P1-068750 | | | | Weak | | | .....D.D.._ | E..D........ | ....._.EE... | 127 |
| | | | | | | | ....... | | | |

Thus, several '029 progeny clones were identified which either maintained or improved $k_{off}$ to VISTA-ECD at pH 6.0 compared to the '029 parent, and also demonstrated weaker $k_{off}$ or a loss of binding to VISTA at physiologic pH. The '015 progeny exhibited acidic pH selective binding to VISTA-ECD, with no binding detected to VISTA at neutral pH, but all '015 progeny assayed yielded a faster $k_{off}$ at pH 6.0 compared to the '015 parent.

Figures 8A, 8B:
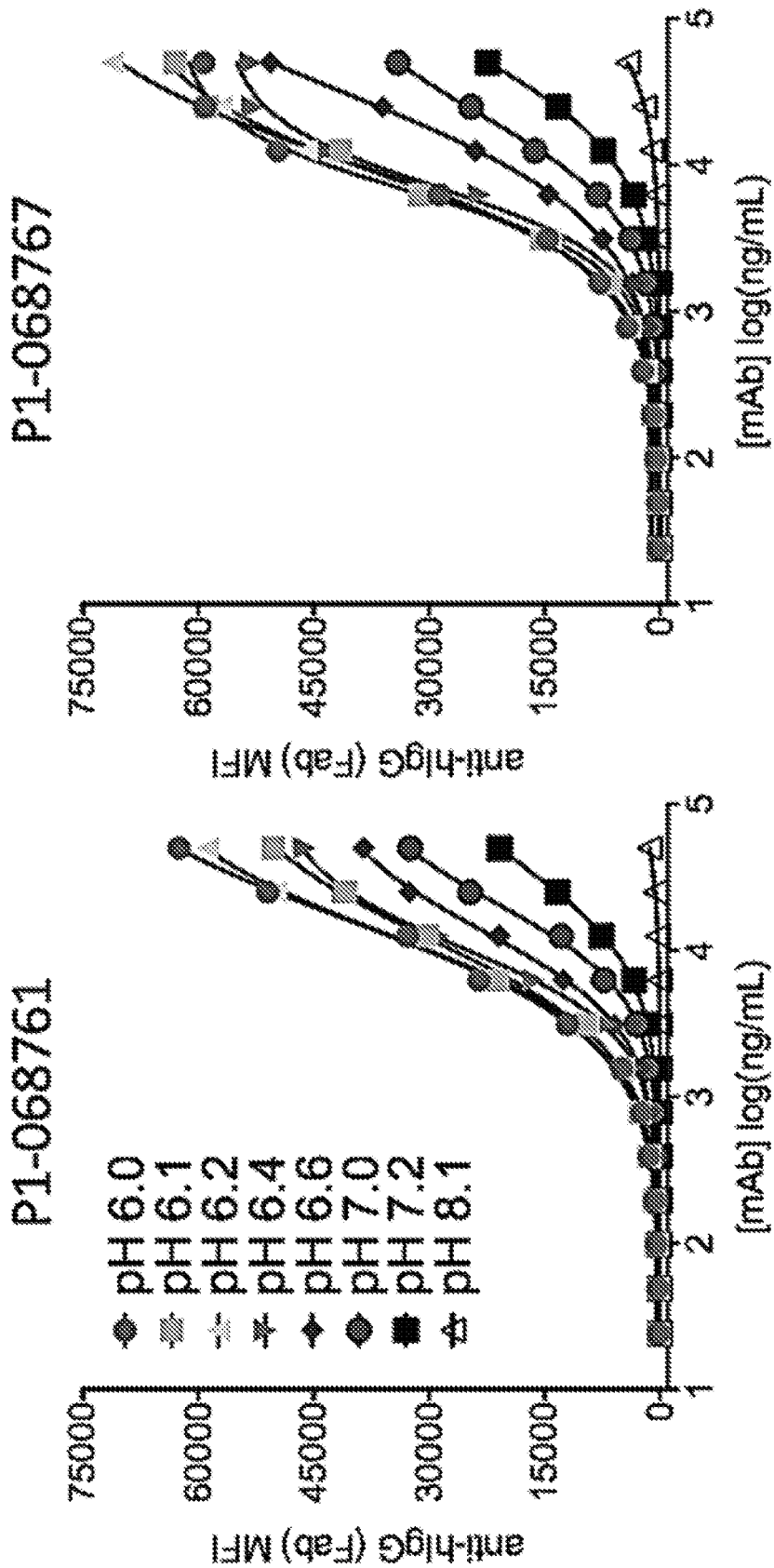
FIGS. 8A-F show acidic pH-selective cell binding, blocking, and effector activity of the VISTA antibodies P1-068761 and P1-068767.

Example 10: Acidic pH-Selective '029 Progeny Demonstrate Acidic pH-Dependent Cell Binding and Effector Function while Maintaining VISTA Blocking Activity pH-dependent binding of clones '761 and '767 to Raji cells engineered to ectopically express full length human VISTA (SEQ ID NO: 1 with D187E substitution) was measured. For this experiment, '761 and '767 were formatted as IgG1.3 antibodies, and binding was measured by an anti-human IgG secondary antibody (Jackson Immunoresearch catalog number 109-065-098). The results, which are shown in FIGS. 8A-8B, indicate that the '761 (FIG. 8A) and '767 clones (FIG. 8B) bind poorly at pH 7.2 and 8.1, but better at acidic pH, particularly at pH 6.0, 6.1, 6.2, and 6.4. Binding MFIs are plotted on the y-axis and primary antibody concentrations are plotted on the x-axis in log scale. Non-linear regressions are also shown.

Figure 8C:
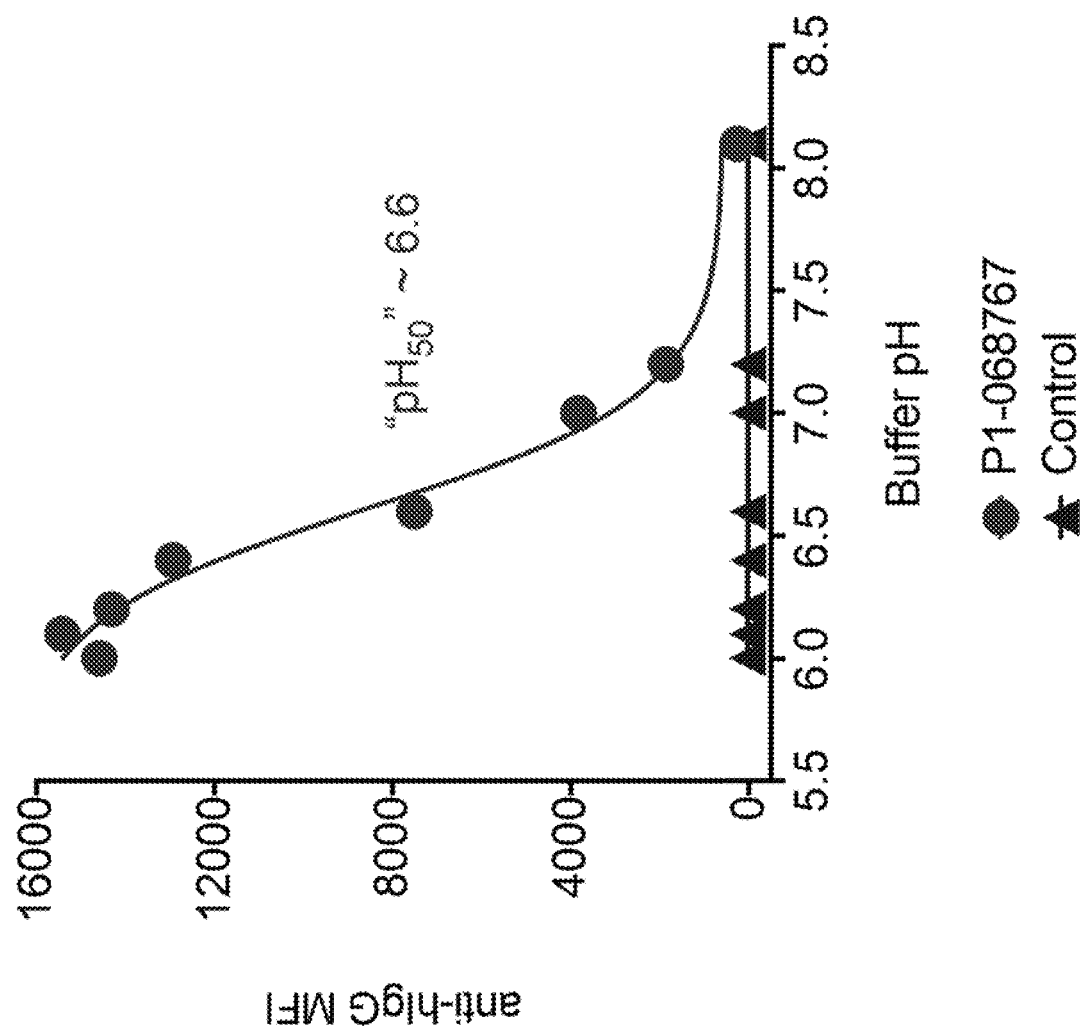

FIG. 8C shows data from the experiment described in FIGS. 8A-B measuring P1-068767 (circles) and an isotype-matched non-specific control antibody (triangles) binding to Raji cells expressing human VISTA at 3125 ng/mL at different pH. The "pH50", the pH at which 50% of P1-068767 binding is lost, is approximately 6.6. Binding MFIs are plotted on the y-axis, and buffer pH is plotted on the x-axis. Non-linear regressions are also shown.

Figure 8D:
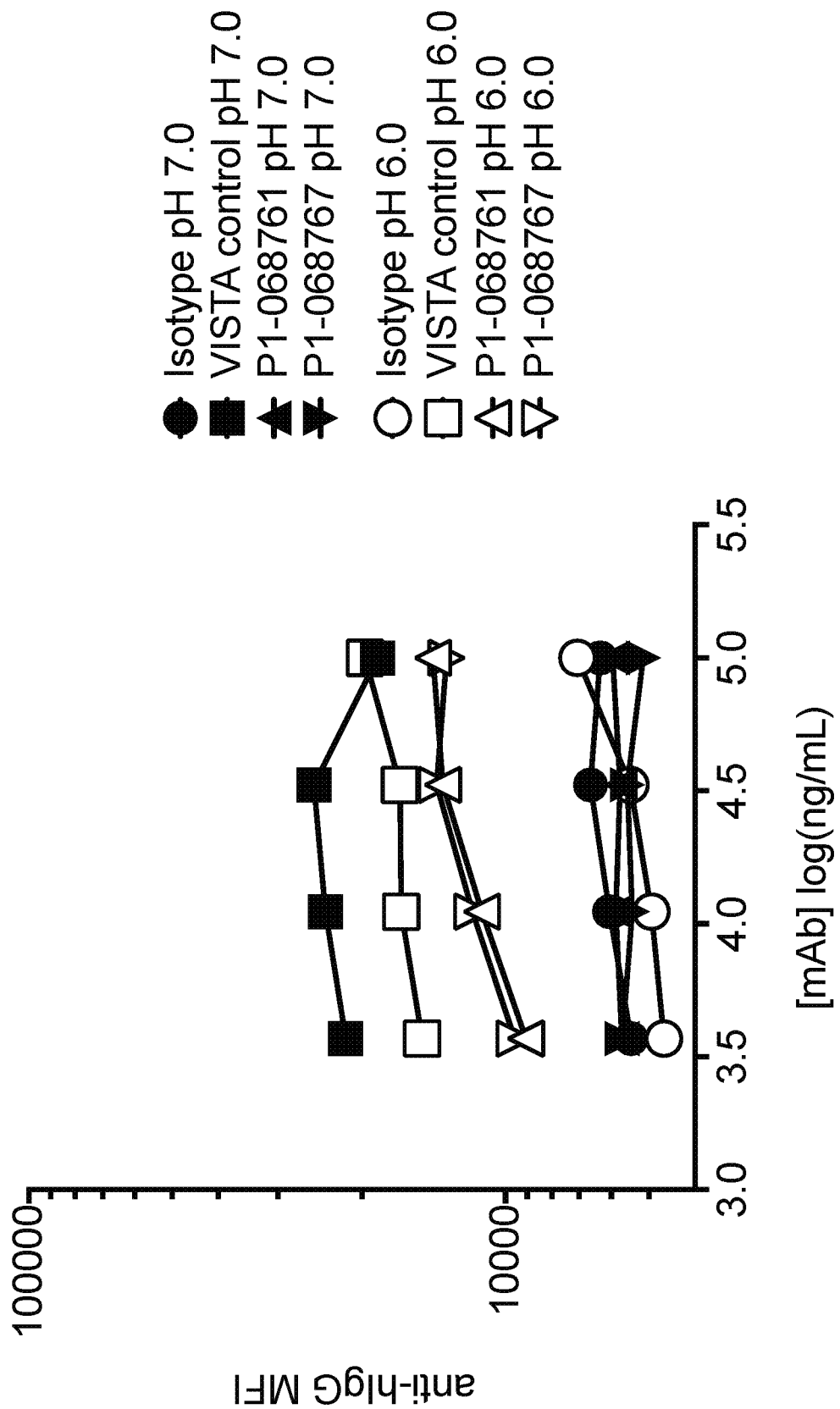

FIG. 8D shows the MFI of an isotype-matched non-specific control antibody (filled and unfilled circles for pH 7.0 and 6.0 respectively), anti-VISTA mAb 2 ("control", see FIG. 6C, filled and unfilled squares at pH 7.0 and 6.0 respectively), P1-068761 (filled and unfilled triangles for pH 7.0 and 6.0 respectively), and P1-068767 (filled and unfilled inverted triangles for pH 7.0 and 6.0 respectively) binding to human monocytes. Binding was detected as described in FIGS. 8A-B. The non-pH-selective VISTA control antibody (mAb 2) bound monocytes at both pH. Both engineered acidic pH-selective antibodies bound monocytes well at pH 6.0, but did not bind better than the non-specific isotype-matched control at pH 7.0. Thus, clones '761 and '767 have weak binding or no binding to VISTA at neutral pH, and instead bind VISTA on cells selectively at acidic pH.

Figure 8E:
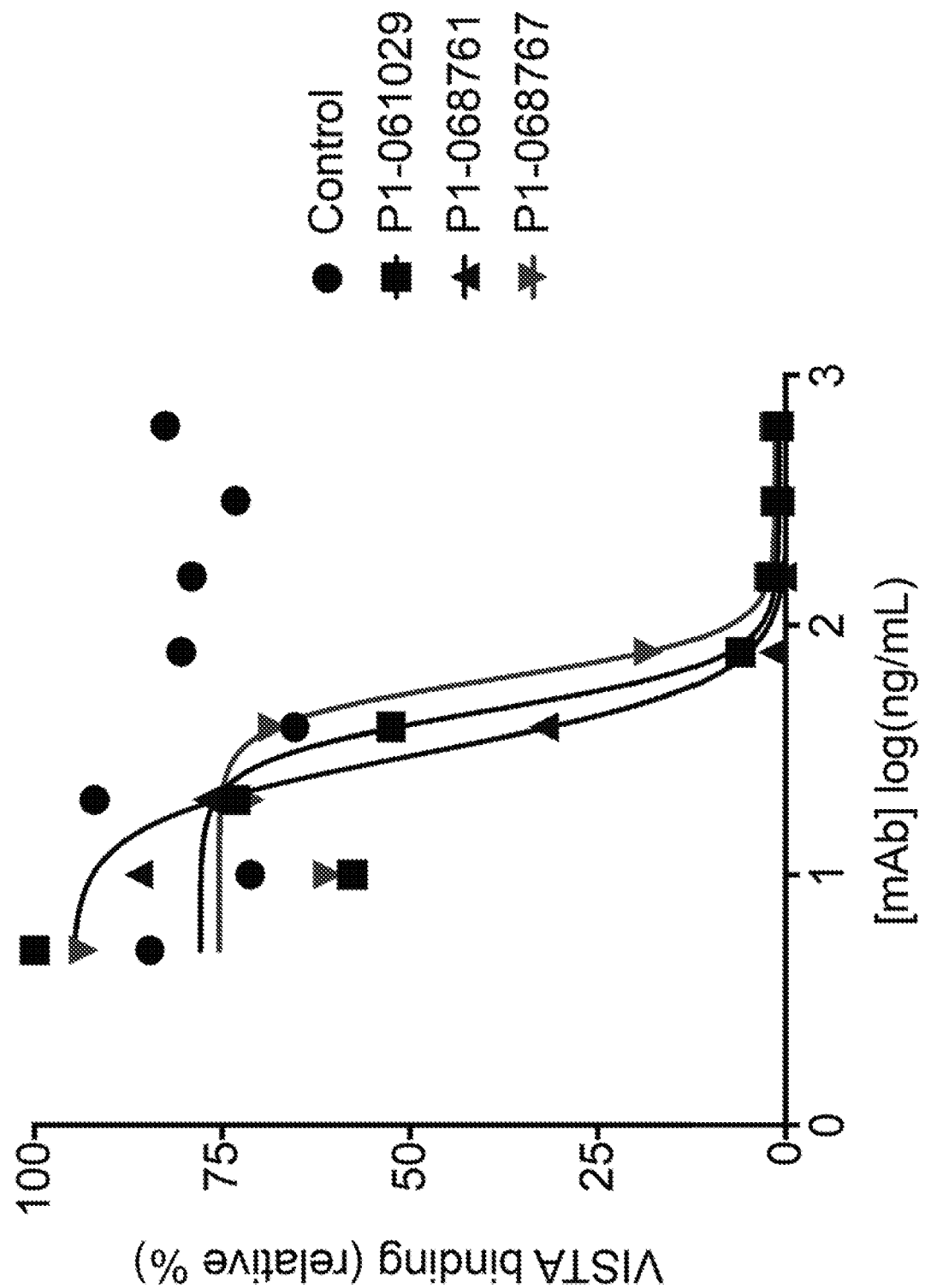

FIG. 8E shows the comparable blocking of recombinant VISTA multimer binding to activated human CD4+ T cells at pH 6.0 by '029 (squares), '761 (triangles), and '767 (inverted triangles), while a non-VISTA-specific control antibody (circles) did not block VISTA binding. This blocking assay was performed as described in Example 4. These data show that engineered acidic pH-selective VISTA antibodies are still capable of blocking VISTA receptor-ligand binding at acidic pH.

NK cell specific lysis of target cells (the same Raji cells expressing human VISTA described in FIGS. 8A-B) via antibody-dependent cell cytotoxicity (ADCC) at physiological pH was measured for the P1-061029.IgG1f, P1-068761.IgG1f, P1-068767.IgG1f antibodies, a non-VISTA-specific antibody and a non-VISTA-specific negative control antibody, all expressed as afucosylated IgG1 antibodies. NK cells were enriched from PBMC via negative bead selection (StemCell Technologies catalog number 19055) and cultured overnight in Myelocult™ media (StemCell Technologies catalog number 05150) supplemented with 1 µM hydrocortisone (StemCell Technologies catalog number 07904) and 500 U/mL recombinant human IL-2 (Peprotech catalog number 200-02). On the day of the assay, Raji cells ectopically expressing human VISTA (described in FIG. 8A-B) were labeled with Calcein AM (Life Technologies catalog number C3100MP) and co-cultured with the cultured NK cells at a 10:1 NK: target cell ratio and with P1-061029.IgG1f, P1-068761.IgG1f, P1-068767.IgG1f antibodies, a non-VISTA-specific antibody and a non-VISTA-specific negative control antibody for 2 hours at physiological pH. Specific lysis was interpolated from the supernatant fluorescence signal (EnVision™ plate reader). The spontaneous lysis signal obtained from co-culture without antibodies, and the maximal lysis signal was determined by lysis of target cells with Delfia® lysis buffer (PerkinElmer catalog number 4005-0010). Antibody-specific lysis was calculated to be the percentage of lysis observed divided by (the maximal lysis signal minus the spontaneous lysis signal).

Figure 8F:
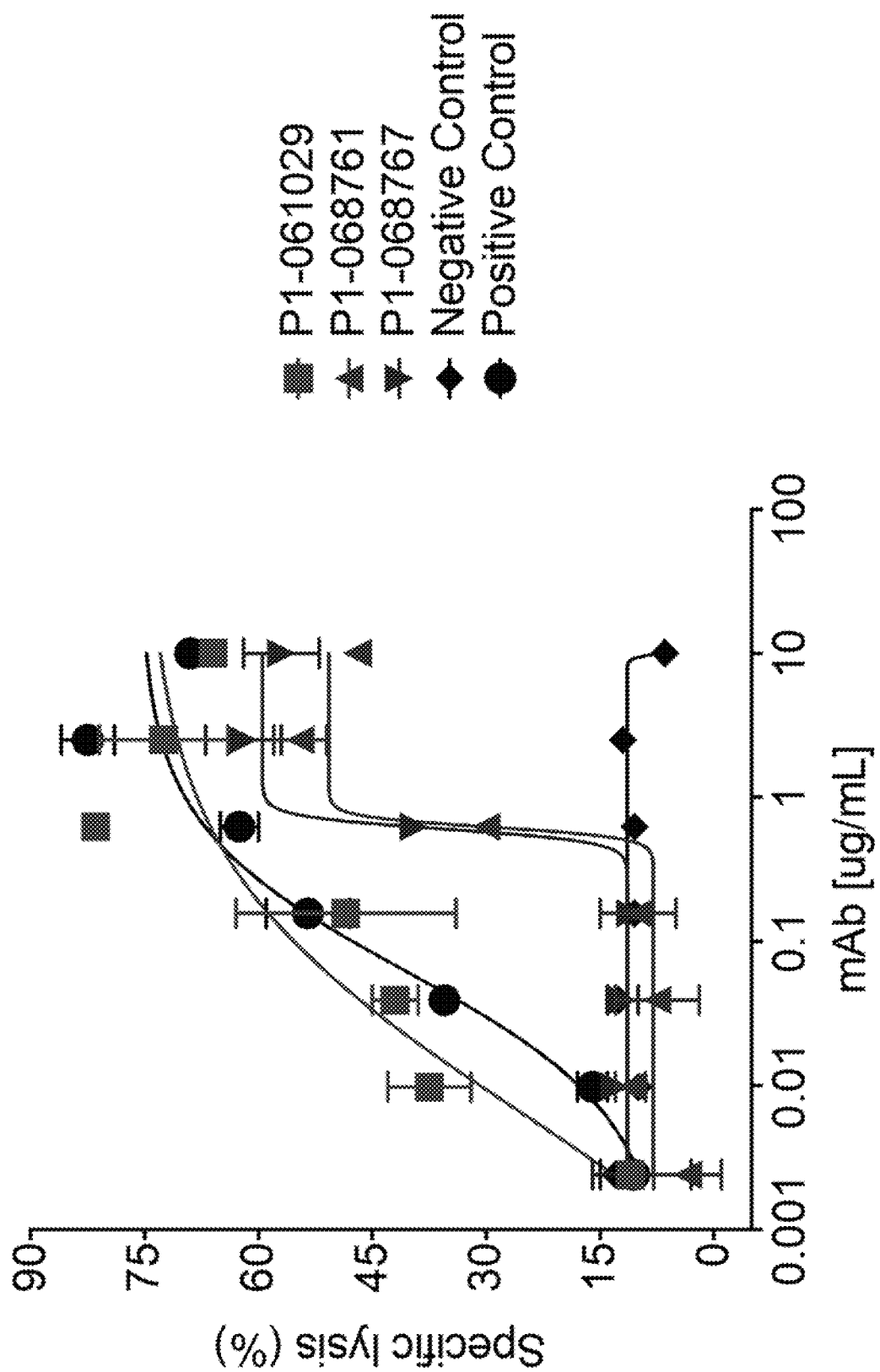

The results, which are provided in FIG. 8F, show the reduced potency of P1-068761.IgG1f and P1-068767.IgG1f, relative to P1-061029 and the positive control in mediating antibody-dependent cell cytotoxicity (ADCC) at physiological pH.

Example 11: Cyno PK of VISTA Antibodies

Human antibody-naïve cynomolgus macaques were injected intravenously with a single 5 mpk dose of either a VISTA antibody which binds comparably at acidic and neutral pH ("control"; mAb2), a VISTA antibody with impaired binding at acidic pH ("acidic pH sensitive", mAb3), or acidic pH-selective antibody '767, to determine the cyno PK of these antibodies.

The SPR binding kinetics of the antibodies used in this Example are provided in Table 11, and were determined as follows. Cyno VISTA cross-reactivity for acidic pH-selective and control anti-VISTA antibodies was evaluated at acidic and neutral pH. Binding affinity measurements for VISTA Abs were conducted using a Biacore® T100 instrument (GE Healthcare). Protein A (ThermoFisher Scientific catalog number #21181) was diluted to 20 µg/ml in 10 mM sodium acetate pH 4.5 and immobilized onto flow cells of a CM5 biosensor following the manufacturer's amine coupling protocol (GE Healthcare), targeting 2,000 RU immobilization density of Protein A per flow cell. The assay was run at 37° C. using PBST (137 mM sodium chloride, 2.7 mM potassium chloride, 10 mM phosphate buffer, 0.05% Tween 20) running buffer at pH 7.4 and 6.0. Antibodies (formatted as IgG1.3 antibodies) were diluted to 25 nM in PBST pH 7.4, and were captured across active biosensor flow cells at 5 ul/min for 45 seconds. Concentration series of 1600-0.78 nM (pH 7.4) and 100-0.78 nM (pH 6.0) monovalent hVISTA-ECD (SEQ ID NO: 325) and cyno VISTA-ECD (AFKVATLYSL YVCPEGQNVT LTCRVFGPVD KGHDVTFYKT WYRSSRGEVQ TCSERRPIRN LTFQDLHLHH GGHQAANTSH DLAQRHGLES ASDHHGNFSI TMRNLTLLDS GLYCCLVVEIRHHHSEHRVH GAMELQVQTG KDAPSSCVAY PSSSQESENI TAHHHHHHH; (SEQ ID NO: 326) were prepared running buffer, and were injected over the captured antibodies at 40 ul/min to measure association and dissociation. Two 15 second injections of 10 mM glycine pH 1.5 were used to regenerate the Protein A capture surface between assay cycles. Rate constants ka ($k_{on}$) and $k_d$ ($k_{off}$) were derived from reference flow cell and 0 nM blank-subtracted sensorgrams, and were fit to a 1:1 binding model in Biacore® T200 Evaluation Software v.2.0. The affinity constant, $K_D$ was calculated as the ratio of rate constants koff/kon for each VISTA antibody. Ratios of $k_{off}$ and $K_D$ at pH 7.4/pH 6.0 were calculated to compare off-rate and affinity differences at acidic pH relative to neutral pH, and are shown in Table 11. All anti-VISTA antibodies tested exhibited comparable (within 2-fold) human and cyno VISTA kinetic binding parameters at both pHs tested, confirming cross-reactivity with cyno VISTA. Both anti-VISTA control antibodies exhibited improved $k_d$ and stronger $K_D$s at physiological pH compared to acidic pH, and the acidic pH-sensitive control exhibited a faster VISTA $k_d$ at acidic pH compared to the control antibody.

TABLE 11

SPR binding kinetics of VISTA antibodies to cyno VISTA

| Antibody | VISTA | pH 7.4 ka (1/Ms) | pH 7.4 kd (1/s) | pH 7.4 KD (M) | pH 6.0 ka (1/Ms) |
|---|---|---|---|---|---|
| P1-061029 | human | 1.2E+05 | 7.5E-03 | 6.2E-08 | 9.8E+05 |
|  | cyno | 1.4E+05 | 6.7E-03 | 4.7E-08 | 6.2E+05 |
| P1-068761 | human | 4.3E+03 | 3.7E-02 | 8.7E-06 | 3.5E+05 |
|  | cyno | 6.5E+03 | 3.6E-02 | 5.5E-06 | 2.1E+05 |
| P1-068767 | human | 1.6E+03 | 3.5E-02 | 2.3E-05 | 3.2E+05 |
|  | cyno | 1.3E+03 | 3.4E-02 | 2.6E-05 | 1.9E+05 |
| α-VISTA control (mAb 3) | human | 4.4E+05 | 1.3E-03 | 3.0E-09 | 9.6E+05 |
|  | cyno | 4.9E+05 | 1.7E-03 | 3.4E-09 | 5.5E+05 |
| α-VISTA acidic pH sensitive (mAb 2) | human | 1.8E+05 | 7.8E-04 | 4.3E-09 | 1.8E+06 |
|  | cyno | 1.9E+05 | 6.8E-04 | 3.5E-09 | 1.2E+06 |

| Antibody | pH 6.0 kd (1/s) | pH 6.0 KD (M) | kd ratio (7.4/6) | KD ratio (7.4/6) |
|---|---|---|---|---|
| P1-061029 | 6.6E-03 | 6.8E-09 | 1.1 | 9.1 |
|  | 6.2E-03 | 1.0E-08 | 1.1 | 4.7 |
| P1-068761 | 1.4E-03 | 4.1E-09 | 26.4 | 2122.0 |
|  | 1.7E-03 | 7.9E-09 | 21.2 | 696.2 |
| P1-068767 | 2.4E-03 | 7.5E-09 | 14.6 | 3066.7 |
|  | 2.5E-03 | 1.3E-08 | 13.6 | 2000.0 |
| α-VISTA control (mAb 3) | 6.0E-03 | 6.2E-09 | 0.2 | 0.5 |
|  | 7.1E-03 | 1.3E-08 | 0.2 | 0.3 |
| α-VISTA acidic pH sensitive (mAb 2) | 5.0E-02 | 2.8E-08 | 0.02 | 0.2 |
|  | 5.2E-02 | 4.4E-08 | 0.01 | 0.08 |

Figure 9:
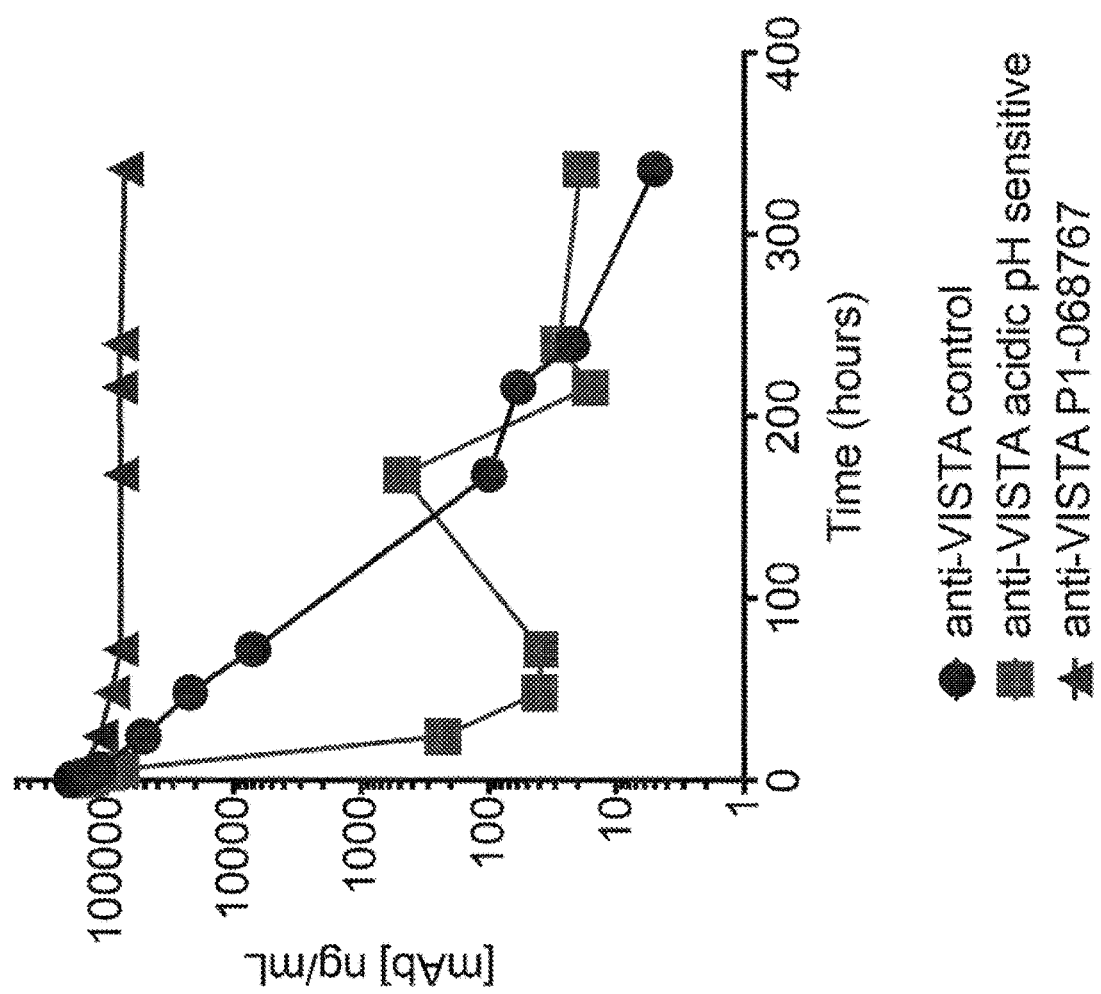
FIG. 9 shows enhanced pharmacokinetics (PK) of acidic pH-selective anti-VISTA antibodies in cynomolgus macaques. The figure shows serum antibody concentrations over time in cynomolgus macaques treated VISTA antibody 2 ("control", circles, see FIG. 6C), VISTA antibody 3 ("acidic pH sensitive", squares, see FIG. 6C), or P1-068767 (triangles).

Human antibody-naïve cynomolgus macaques were injected intravenously with a single 5 mpk dose of either VISTA mAb2 ("control"), VISTA mAb3 ("acidic pH sensitive"), or P1-068767.IgG1.3. The serum concentration of each antibody following injection is shown in FIG. 9. Mean residence times for P1-068767.IgG1.3 and the control anti-VISTA antibody were 717 and 22 hours respectively, indicating that acidic pH selectivity greatly reduced VISTA antibody Target Mediated Drug Disposition (TMDD). Although the control antibody (mAb 2) and the acidic pH sensitive antibody (mAb 3) bind VISTA comparably at physiological pH, the acidic pH sensitive antibody had a lower mean residence time of 7.6 hours, demonstrating the importance of acidic pH binding to VISTA antibody recycling as described in Examples 6 and 7. The results show that acidic pH selective antibodies have superior PK and will thus more easily achieve target engagement in tumors or other microenvironments.

Example 12: pH Selective '029 Progeny do not Bind Non-Specifically to High PI Proteins The binding specificity of the '029, '761 and '767 clones to VISTA and to other high pI proteins was evaluated by SPR at neutral and acidic pH using a Biacore® T100 instrument (GE Healthcare). Protein A (ThermoFisher Scientific catalog #21181) was diluted to 20 µg/ml in 10 mM sodium acetate pH 4.5 and immobilized onto flow cells of a CM3 biosensor following the manufacturer's amine coupling protocol (GE Healthcare), targeting 800 RU immobilization density of Protein A per flow cell. SPR experiments were conducted at 25° C. using PBST (137 mM sodium chloride, 2.7 mM potassium chloride, 10 mM phosphate buffer, 0.05% Tween 20) running buffer at pH 7.4 and 6.0. Antibodies (formatted as IgG1.3 antibodies) were diluted to 50 nM in PBST pH 7.4, and were captured across active biosensor flow cells at 5 ul/min for 60 seconds. A concentration series of 100-10 nM monovalent hVISTA-ECD (SEQ ID NO: 325), avidin (ThermoFisher Scientific catalog #21128), cytochrome C (Sigma catalog #C2867), BSA (Calbiochem catalog #126593), and monovalent control antigen ("Ag") were prepared in pH 7.4 and 6.0 running buffers, and were injected over the captured antibodies at 50 ul/min to evaluate binding specificity. Two 15 second injections of 10 mM glycine pH 1.5 were used to regenerate the Protein A capture surface between assay cycles. Reference flow cell and 0 nM blank-subtracted sensorgrams were inspected using Biacore® T200 Evaluation Software v.2.0. The results are shown in Table 12.

the co-cultured cells. Jurkat activation is shown as luciferase units and as the fold-increase of the luciferase signal with anti-VISTA treatment relative to control.

Example 14: Mutational Analysis Identified Key Residues Conferring pH Dependent Binding Properties to VISTA Antibodies Antibodies P1-068761.IgG1.3 and P1-068767.IgG1.3 contain 5-6 mutations from P1-061029 (Table 7). A mutational analysis was conducted in order to identify key residues important for conferring the pH dependent properties of the VISTA antibodies. As such, a panel of N–1 (1 amino acid reversion to P1-061029) and N-2 (2 amino acid reversion to P1-061029) variants of P1-068761 and P1-068767 were synthesized, expressed as IgG1.3, and analyzed for their binding to huVISTA at pH 6, pH 6.7, and pH 7.4.

Binding kinetics were measured using a Biacore® T100 instrument (GE Healthcare). Protein A (ThermoFisher Scientific catalog #21181) was diluted to 20 µg/ml in 10 mM sodium acetate pH 4.5 and immobilized onto flow cells of a CM5 biosensor following the manufacturer's amine coupling protocol (GE Healthcare), targeting 2,000 RU immobilization density of Protein A per flow cell. The assay was

TABLE 12

Binding of VISTA clones to proteins having a high pI

| Sample | Isoel. pt (pI) | '029 pH 6 | '029 pH 7.4 | '761 pH 6 | '761 pH 7.4 | '767 pH 6 | '767 pH 7.4 | Anti-Ag pH 6 | Anti-Ag pH 7.4 | PBS (no Ab) pH 6 | PBS (no Ab) pH 7.4 |
|---|---|---|---|---|---|---|---|---|---|---|---|
| huVISTA-His | 6.9 | X | X | X | | X | | | | | |
| Avidin | 10 | | | | | | | | | | |
| Cyto-Chrome C | 10.7 | | | | | | | | | | |
| BSA | 4.7 | | | | | | | | | | |
| Ag-His | 6.5 | | | | | | | X | X | | |

In Table 12, specific binding, defined as >10 RU SPR binding responses at the end of the sample injection is indicated by an "X." "Anti-Ag" is an VISTA binding control Ab. The '029 clone was specific for VISTA at acidic and neutral pH. The '029 progeny clones '761 and '767 were specific for VISTA at acidic pH, while the control antibody also maintained antigen specificity. Non-specific binding ("NSB") of the pI control proteins to the Protein A reference surface was not observed in this assay.

Thus, the charged amino acids introduced to the VH CDRs of '761 and '767 do not cause these antibodies to bind electrostatically to other high pI proteins, such as avidin and cytochrome C, or low pI proteins, such as BSA.

Example 13: Inhibition of T Cell Activation by Antibodies '761 and '767

This Example describes an assay that can be conducted to determine the ability of antibodies '761 and '767 to block hVISTA inhibition of Jurkat T cell activation.

The same assay as described in Example 5 is used. Briefly, Jurkat (human T cell line) cells expressing an NFkB luciferase reporter are co-cultured at various pH with 293T cells expressing human VISTA and a single-chain variable fragment of the anti-human T cell receptor agonist antibody OKT3. Anti-VISTA antibodies '761 and '767 or an isotype-matched non-VISTA-specific control antibody are added to conducted at 37° C. using PBST (137 mM sodium chloride, 2.7 mM potassium chloride, 10 mM phosphate buffer, 0.05% Tween 20) running buffer at pH 7.4, 6.7 and 6.0. Antibodies were diluted to 25 nM in PBST pH 7.4, and were captured across active biosensor flow cells at 5 ul/min for 40 seconds. A concentration series of 100-10 nM monovalent hVISTA-ECD (SEQ ID NO: 325) was prepared in pH 7.4, 6.7 and 6.0 running buffers, and was injected over the captured antibodies at 40 ul/min to measure association and dissociation. Two 15 second injections of 10 mM glycine pH 1.5 were used to regenerate the Protein A capture surface between assay cycles. Rate constants ka ($k_{on}$) and $k_d$ ($k_{off}$) were derived from reference flow cell and 0 nM blank-subtracted sensorgrams, and were fit to a 1:1 binding model in Biacore® T200 Evaluation Software v.2.0.

The affinity constant, $K_D$ was calculated as the ratio of rate constants $k_{off}/k_{on}$ for each VISTA antibody. The % Rmax was calculated to compare how pH affects an antibody's binding capacity for VISTA, and represents the measured maximal VISTA binding response relative to the expected maximal VISTA binding response. The % Rmax is defined as the ratio of the reference-subtracted 'binding' report point response at the end of the 100 nM VISTA injection for each antibody (Rmax) relative to the expected VISTA binding response (Rexp). Rexp is calculated as Rexp=[(VISTA-ECD molecular weight/mAb molecular weight)×(mAb 'capture' report point response (RUs)]×2 binding sites per mAb.

The SPR results obtained for P1-068761 reversion variants are shown in FIG. 10A, which is ranked by the pH 6.0 $k_{off}$, slowest to fastest. In the table, antibodies that exhibited weak or no binding response (<10 RU) to 100 nM hVISTA were categorized as non-binding (NB). The results indicate that E at positions 32 (i.e., amino acid residue 7 in VH CDR1 of '761) and 100f (amino acid residue 12 in VH CDR3 of '761) are both required for maintaining acidic pH selectivity, since these reversions to P1-061029 parent sequence allowed for significant hVISTA binding at physiological pH (% Rmax>10). Further analysis revealed that variants with E55A (amino acid residue 6 in VH CDR2 of '761) reversion maintained acidic pH-selectivity and exhibited comparable binding kinetics within 2-fold of P1-068761. In contrast, while variants with H100G, E56N and E30D (amino acid residues 12 of VH CDR3, 7 of VH CDR2 and 4 of VH CDR1 of '761, respectively) reversions maintained acidic pH selectivity, these mAbs also exhibited ~3-fold faster $k_{off}$ at acidic pHs compared to P1-068761, bringing the off-rates of these mutants at acidic pH closer to the P1-061029 parent. Thus, adding G100H, N56E and/or D30E mutations to the original P1-061029 clone contributed to acidic pH VISTA affinity improvements observed in the acidic selective P1-068761 clone.

The SPR results obtained for P1-068767 reversion variants are shown in FIG. 10B, which is ranked by the pH 6.0 $k_{off}$, slowest to fastest. The results indicate that D at position 102 (amino acid residue 14 in VH CDR3 of '767) was required for maintaining acidic pH selectivity, and D102V reversion back to P1-061029 parent sequence allowed for significant hVISTA binding at neutral pH (% Rmax>10). Further analysis revealed that variants with E30D, D52N and E55A (amino acid residues 4 of VH CDR1, 3 of VH CDR2 and 6 of VH CDR3 of '767, respectively) reversions maintained acidic pH-selectivity and exhibited comparable pH 6.0 binding kinetics within 2-fold of P1-068767. In contrast, variants with E100fF (amino acid residue 12 of VH CDR3 of '767) reversion maintained acidic pH selectivity, albeit with >3-fold faster $k_{off}$ at acidic pH compared to P1-068767. Notably, variants with E100fF reversion exhibited even faster $k_{off}$ at acidic pH compared to the parent mAb P1-061029.

Confirmatory kinetic binding data obtained were obtained (using the methodoly described in Example 9) with some of the reversion mutants, and the data are shown in Tables 22 and 23.

Thus, a summary of the reversion mutants of P1-068761 and P1-068767 (acidic pH-selective) relative to P1-061029 (pH-tolerant) is as follows in Table 13 (HCDR1, HCDR2, and HCDR3 are separated by an underscore).

on pH 6.0 $k_a$ compared to P1-068761 and P1-068767 are underlined.

Next, mutations F100fE, V102D and Y32E were introduced into '029 alone or together to determine whether these amino acid substitutions are sufficient for rendering '029 pH selective. The following antibodies were created: P1-061029_F100fE_V102D (P1-072000); P1-061029_F100fE (P1-072002); P1-061029_V102D (P1-072004); P1-061029_Y32E (P1-072006) and P1-061029_Y32E_F100fE (P1-072008), and their binding kinetics were determined as described in Example 9. The amino acid sequences of their CDRs are shown in Table 23. The results, which are shown in Table 22, indicate that V102D is sufficient for making '029 pH selective, but the binding kinetics are improved if F00fWE is also present. However, F100fE or Y32E on their own do not render '029 pH selective.

Example 15: Mapping of VISTA Antibody Epitopes

The hVISTA epitopes of '015, '029, '761 and '767, formatted as IgG1.3 antibodies, were determined by 2 different methods: BLI (bio-layer interferometry) competition and yeast surface display.

Competitive BLI epitope binning assays were conducted to evaluate whether acidic pH-selective VISTA antibodies P1-068761 and P1-068767 retained similar or overlapping epitopes on VISTA compared to the P1-061029 parent, P1-061015 and relevant VISTA control antibodies 1, 2 and 3. Sandwich and tandem format binning assays were performed on an OctetRed384 BLI instrument (PALL/ForteBio). All assay steps were performed at 30° C. at 1000 rpm shake speed, and the buffer used was acidic (pH 6.0) or neutral (pH 7.4) PBST (137 mM sodium chloride, 2.7 mM potassium chloride, 10 mM phosphate buffer, 0.05% Tween 20). For the sandwich format, anti-human IgG-Fc sensors (AHC, PALL/ForteBio) first captured the VISTA antibody panel at pH 7.4, then the anti-human capture sensors were blocked with total human IgG (Jackson #009-000-002). Human VISTA-ECD was captured next at pH 6.0, and finally competition for all possible antibody combinations was assessed at pH 6.0. In the tandem format assay, streptavidin-coated biosensors (SAX, PALL/ForteBio) first captured biotinylated hVISTA-ECD at pH 7.4, then the sensors captured the full VISTA antibody panel at pH 6.0, ensuring complete binding saturation of each antibody on VISTA before evaluating competition with all possible antibody combinations at pH 6.0.

TABLE 13

|  |  | Seq Id. |
|---|---|---|
| P1-061029 | GFTLDDYAMH_GINWNSANIGYADSVKG_VPGYSGGWIDAFDV | 67 |
| P1-068761 | ....E.E..._......EE........._.....H.....E.. | 51 |
| P1-068767 | ....E....._..D...E........._...........E.D | 55 |
| aa pos. | 26-35       50-66              99-110 | |

Figure 11A:
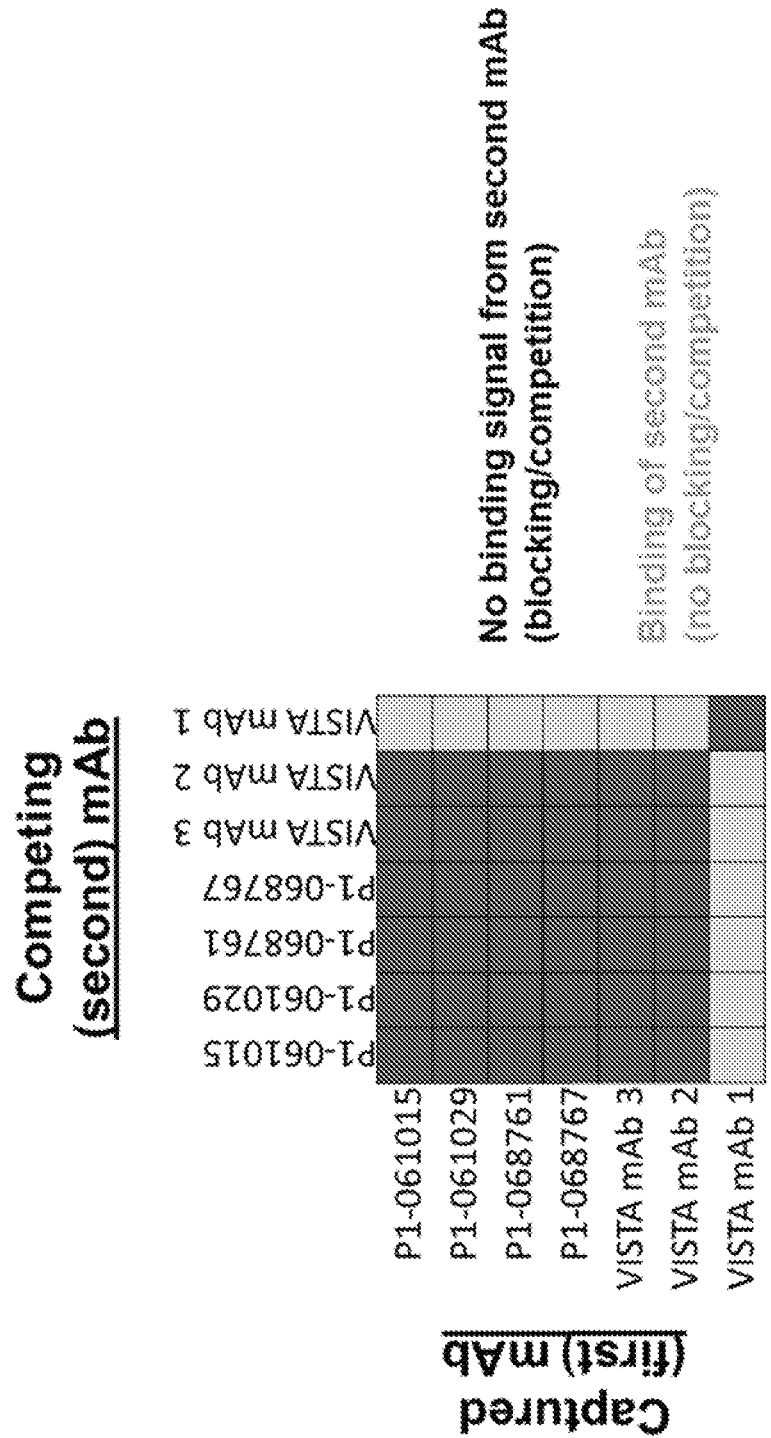

The above VH CDR sequences for P1-061029, P1-068761, and P1-068767 in Table 13 are at amino acids ("aa pos.") 26-35, 50-66, and 99-110 of SEQ ID NOs: 67, 51, 55, respectively. Key mutations required for acid pH-selectivity are indicated in bold, and mutations with over 3 fold impact The results of the Competitive BLI epitope binning assays are summarized by a competition matrix, FIG. 11A. In this figure, the first antibody captured is listed by row, and its binding or blocking activity to the (second) competitor antibodies are shown in each column. The competition matrix was identical for both assay formats. For the sandwich assay, binding (light gray) of the competitor antibody was defined by a signal ranging between 0.4-1.2 nm, and blocked antibodies (black) exhibited non-binding signal<0.1 nm. For the tandem assay, binding of the competitor antibody was defined by a signal ranging between 0.3-0.8 nm, and blocked antibodies exhibited non-binding signal<0.2 nm. While 'VISTA mAb 3' exhibited a fast acidic pH dissociation from hVISTA-ECD by SPR at 37° C. (FIG. 6C), it did not rapidly dissociate in either BLI assay format (conducted at 30° C.). These competitive assays indicated that P1-061015, P1-061029, acidic-pH selective antibodies P1-068761 and P1-068767 and VISTA antibodies 2 and 3 all compete with one another for similar or overlapping epitopes on VISTA. However, VISTA antibody 1 binds to a separate and distinct epitope. Thus, the charged amino acid mutations introduced to the VH CDRs of P1-061029 to generate the acidic-selective clones P1-068761 and P1-068767 have not significantly altered the VISTA binding epitope.

The epitopes of antibodies '029, '015, '761, and '767 were also mapped using yeast surface display and NGS according to the method of Chao et al. (2004) *J. Mol. Biol.* 342:539-550, Oliphant et al. (2006) *J. Virol.* 80:12149-12159, and Kowalsky et al. (2015) *J. Biol. Chem.* 290:26457-26470. Briefly, a saturation mutagenesis library of single point mutants of the VISTA ECD was generated and displayed on the surface of yeast. VISTA mutants that lost binding to the antibody being mapped but retained binding to a non-blocking antibody (mAb1) were sorted and sequenced. Since they retained binding to mAb1, these mutants were likely correctly folded, and the loss of binding seen to the antibody being mapped was likely due to the loss of an energetically important contact residue. The positions of these mutations were designated as energetically important residues in the antibody's epitope and are shown in Table 14.

TABLE 14

Residues of huVISTA that are identified as epitope residues of anti-VISTA mAbs

| mAb | T 35 | Y 37 | K 38 | T 39 | Y 41 | R 54 | T 61 | F 62 | Q 63 | L 65 | H 66 | L 67 | H 68 | H 69 | F 97 |
|---|---|---|---|---|---|---|---|---|---|---|---|---|---|---|---|
| P1-061015 | | x | x | x | | x | | x | x | x | x | | | | x |
| P1-061029 | | x | | x | x | x | x | x | x | x | x | | x | x | |
| P1-068761 | x | x | | x | | x | x | x | x | | x | x | x | x | |
| P1-068767 | | x | | x | x | x | x | x | x | x | | | | | |

| mAb | L 115 | V 117 | I 119 | H 121 | H 122 | S 124 | E 125 | R 127 |
|---|---|---|---|---|---|---|---|---|
| P1-061015 | x | x | x | | | x | x | |
| P1-061029 | x | x | x | | | x | x | x |
| P1-068761 | x | x | x | | | x | x | x |
| P1-068767 | x | x | x | x | x | x | x | x |

Table 15 includes detailed data from Table 14, and lists the amino acid residues of hVISTA that are likely to reduce binding of each antibody listed, based on residue frequency observed in the yeast surface display/NGS method

TABLE 15

VISTA amino acid substitutions likely to reduce binding of the listed antiobodies

| | P1-061015 pH 6 | P1-061015 pH 7 | P1-061029 pH 6 | P1-061029 pH 7 | P1-068761 pH 6 | P1-068767 pH 6 |
|---|---|---|---|---|---|---|
| T35 | | | | | P, Y, W | |
| Y37 | P, G, A, S, T, K, R, H, N, D, E, Q | P, G, S, N, D, E Q | Y, S, T, V, L, I, M, K, R, N, D, Q | P, G, S, T, V, L, I, M, K, R, N, D, E, Q | P, G, A, S, T, V, L, I, M, K, R, N, D, E, Q | G, T, V, L, I, M, K, R, N, Q |
| K38 | P, G, A, S, V | | | | | |
| T39 | G, M, R, H, F, Y, W, N, D, E, Q | M, K, R, H, F, Y, W, D, E, Q | G, A, S, M, Y, W, N, D, E, Q | G, A, S, V, L, M, R, H, F, Y, W, N, D, E, Q | G, Y, D, E | G, A, S, H, Y, W, N, D, E, Q |
| Y41 | | | | A, S, T, I, M | | P, I, M, H |
| R54 | L, M, F, Y, E | M, E | P, A, T, V, I, M, F, Y, N, D, E, Q | P, G, A, S, T, V, L, I, M, H, F, Y, W, N, D, E, Q | A, T, V, L, I, M, K, F, Y, E, Q | P, A, S, T, V, L, I, M, F, Y, W, D, E, Q |

TABLE 15-continued

VISTA amino acid substitutions likely to reduce binding of the listed antibodies

| | P1-061015 pH 6 | P1-061015 pH 7 | P1-061029 pH 6 | P1-061029 pH 7 | P1-068761 pH 6 | P1-068767 pH 6 |
|---|---|---|---|---|---|---|
| T61 | | | G, L, R, H, F, Y, D, E, Q | V, L, K, R, H, F, Y | G, V, H, Y, D | L, R, H, F, Y, D, E |
| F62 | G, A, S, M, K, R, N, D, E, Q | G, K, R, D, E, Q | P, G, A, S, T, V, I, M, H, Y, W, D, E, Q | P, G, A, S, T, V, L, I, M, K, R, H, Y, W, N, D, E, Q | P, G, A, S, T, V, M, H, Y, W, D, E, Q | P, G, A, S, T, V, L, M, H, Y, W, N, D, E, Q |
| Q63 | G, R, W, D, E | W, D, E | G, A, S, T, V, K, R, H, Y, W, N, D, E | P, G, S, T, L, M, K, R, H, F, Y, W, N, D, E | G, S, T, K, H, Y, N, D, E | P, G, A, S, T, V, L, I, M, K, H, F, Y, W, N, D, E |
| L65 | P, G, A, S, T, K, R, H, W, N, D, E, Q | P, G, S, K, W, D, E, Q | G, T, Y, D, E, Q | P, G, A, S, T, H, Y, W, N, E, Q, | | P, G, S, H, D, E, Q |
| H66 | P, T, V, L, I, M, K, R, F, Y, W | P, T, V, L, I, M, K, R, F, Y, W | T, V, L, I, Y, D, E, Q | G, S, T, V, L, I, M, K, R, W, N, D, E, Q | T, I, K, W, D | T, V, I, K, W, D, E |
| L67 | | | | | G, A | |
| H68 | | |

720NV Autosampler. Antibody samples were mixed with a separation mixture to yield final concentrations of 0.2 mg/ml antibody, 0.35% methyl cellulose, 2.0 M Urea, 1% v/v pharmalyte pI 5-8, and 3% v/v pharmalyte pI 8-10.5. These samples were analyzed using a pre-focus time of 1 min at 1500V, and focusing time of 10 min at 3000V, in a Protein-Simple cIEF cartridge FC-coated (product #101701). Data were analyzed using iCE CFR Software V4.3.1.5352.

Antibody hydrodynamic size was determined by dynamic light scattering (DLS) and thermal stability was characterized by fluorescence spectroscopy and static light scattering (SLS) using an UNcle molecular characterization instrument (Unchained Labs). Antibodies P1-061029, P1-068761, and P1-068767 were prepared at a concentration of 2 mg/ml in 1×PBS buffer, and then diluted 1:1 with either 40 mM Tris in 1×PBS, or 40 mM citrate in 1×PBS, at different pH to yield final samples of 1 mg/ml antibody in either 20 mM Tris/1× PBS, or 20 mM citrate/1× PBS at pH 3.0, 4.0, 5.0, 6.0, 7.0, 8.0 or 9.0. These samples were loaded into a UNi cuvette cartridge and analyzed within 1 hour of dilution into the different pH formulations. DLS data were collected at 25° C., using 4 acquisitions of 5 s each. Intensity autocorrelation functions were fitted using UNcle analysis software version V2.0. Thermal denaturation data was obtained by scanning samples from 25oC to 90° C. at a scan rate of 0.5o/min, with excitation at 266 nm and 473 nm. Fluorescence data was acquired over a range of 250 nm-720 nm. Fluorescence and SLS data were analyzed using UNcle analysis software version V2.0.

The apparent viscosity of antibodies P1-061029, P1-068761, and P1-068767 was measured on an UNcle molecular characterization instrument (Unchained Labs), using a bead-based DLS method which measures the diffusion rate of polystyrene beads in the presence of formulated antibody solutions, as per Unchained Labs recommended protocol. Briefly, a 10% solution of 100 nm polystyrene beads (Thermo Scientific cat #3100A) was prepared in formulation buffer containing 0.5% tween 80. 3 ul of this polystyrene bead mixture was added to 30 ul of formulated antibody (various Ab concentrations in 20 mM histidine, 260 mM sucrose pH 6.0) and the resulting protein/bead mixture was loaded into 3 separate lanes of a UNi cuvette cartridge (9 ul each lane) for triplicate analysis. Data were analyzed using UNcle analysis software version V2.0, using a reference viscosity of 1.3 cP.

The physical stability of antibodies P1-061029, P1-068761, and P1-068767 was studied under accelerated stress conditions by preparing 50 mg/ml antibody samples in 20 mM histidine, 260 mM sucrose pH 6.0 and exposing to 40° C. thermal stress for 4 weeks. Aliquots were removed immediately prior to 40° C. incubation (time zero=t0), as well as after 1 week (1 w) and 4 weeks (4 w) of thermal stress, and samples were diluted to 2 mg/ml using formulation buffer and analyzed by aSEC. The aSEC data was acquired using an Agilent 1260 HPLC instrument using a Shodex KW403-4F column (4.6 mmID×300 mmL), in buffer containing 100 mM Sodium Phosphate, 150 mM Sodium Chloride, pH7.3(0.2 um filtered) running at a flow rate of 0.30 mL/min. Data were collected by an Agilent 1260 Infinity Diode Array Detector set to collect at 280 nm and analyzed by Agilent Chemstation software (Agilent, Santa Clara, CA).

The resuts are as follows. Analytical size exclusion chromatography (aSEC) data showed that all three antibodies could be purified to high purity, with each antibody sample consisting of more than 99.3% monomer (main peak), less than 0.7% high molecular weight (HMW) species, and undetectable levels of low molecular weight (LMW) species, Table 16.

TABLE 16

Analytical SEC data for anti-VISTA antibodies, showing the percentage of high molecular weight species (% HMW), percentage of monomeric/main species (% Main) and percentage of low molecular weight species (% LMW).

| Sample Name | % HMW | % Main | % LMW |
|---|---|---|---|
| P1-061029 | 0.4 | 99.6 | 0.0 |
| P1-068761 | 0.6 | 99.4 | 0.0 |
| P1-068767 | 0.5 | 99.5 | 0.0 |

Figure 12A:
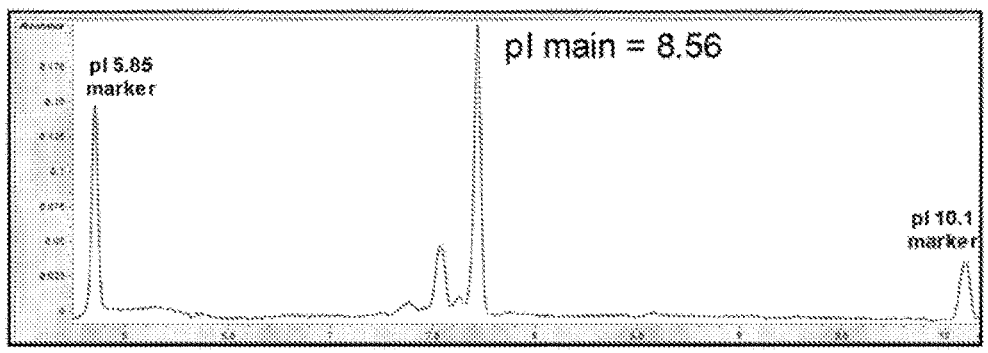
FIGS. 12A-C show imaged capillary isoelectric focusing (icIEF) data for the following.
Figure 12B:
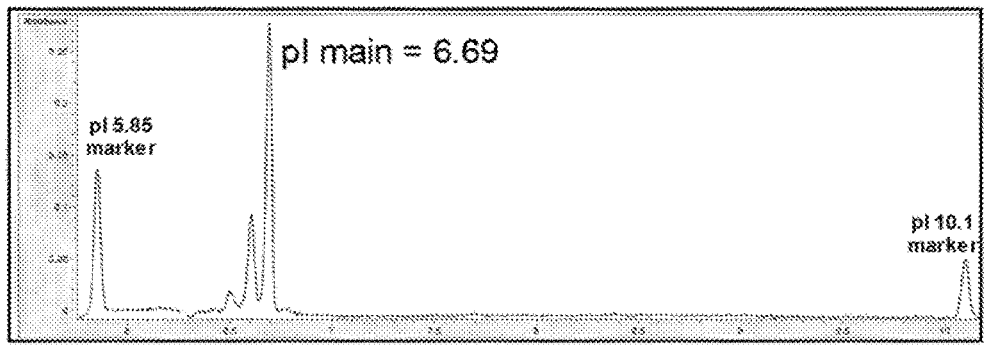
Figure 12C:
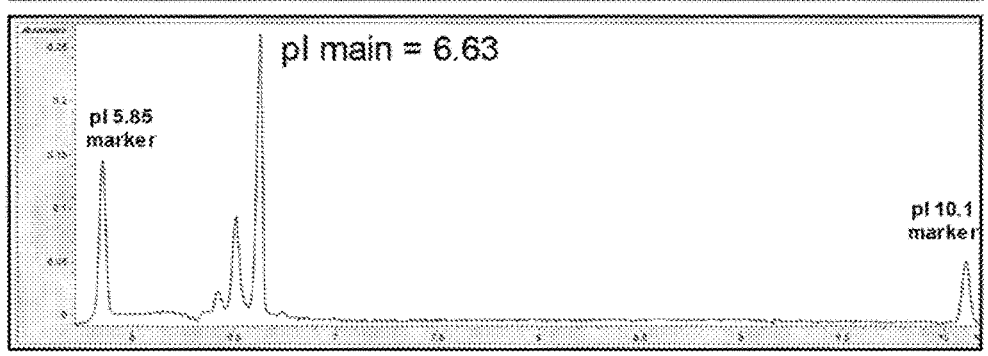
Figure 13A:
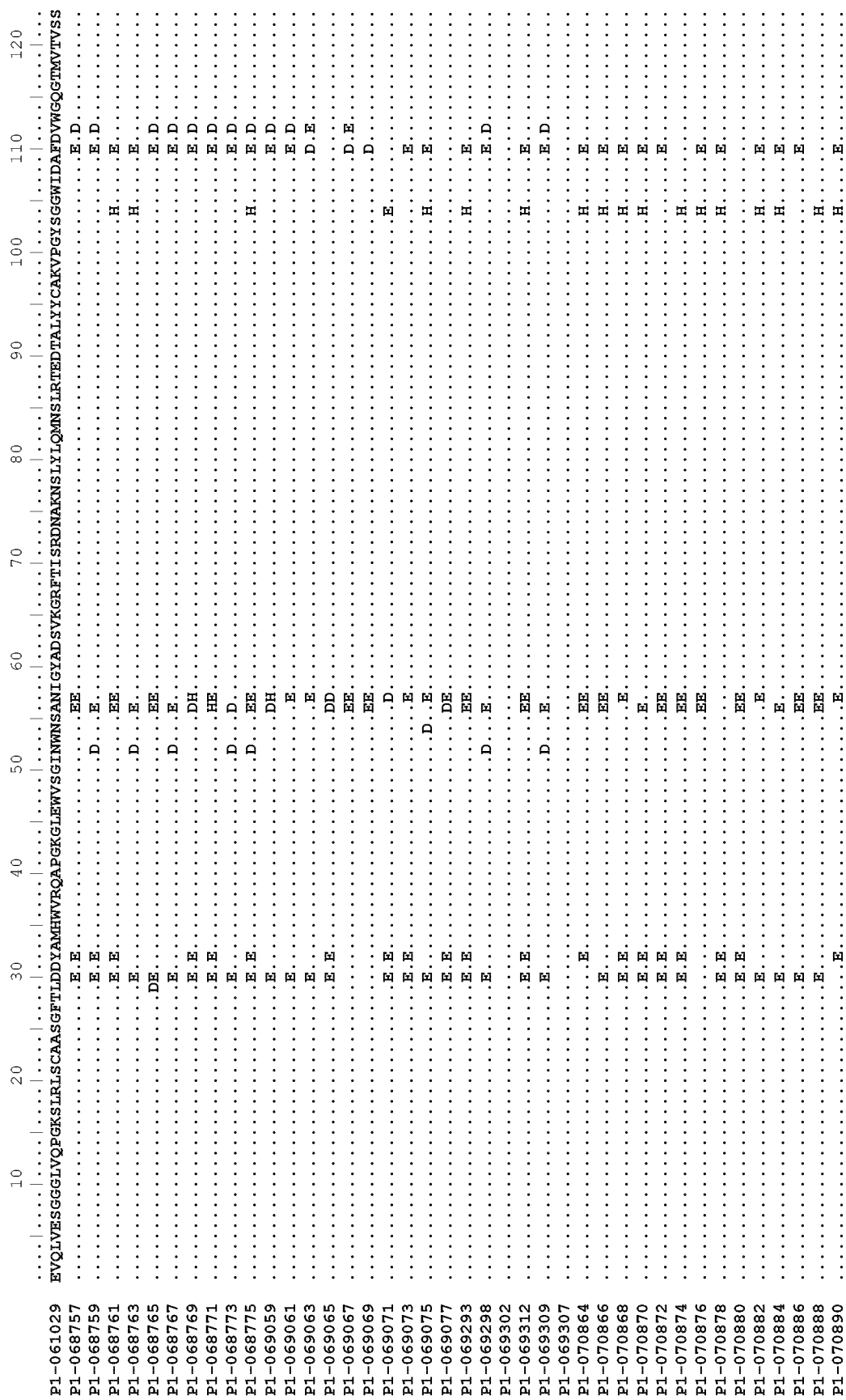
FIGS. 13A and B show alignments of variable regions for '029 and '015 progeny clones.

The charge variant profile as determined by imaged capillary isoelectric focusing (icIEF) for antibody P1-061029 showed the presence of a main species (69.4%) with isoelectric point (pI) of 8.56, and 30.6% acidic species. (FIG. 12A-C.) P1-068761 demonstrated a main species (66.4%) with pI of 6.69 and 33.6% acidic species. P1-068767 demonstrated a main species (61.4%) with pI of 6.63 and 38.6% acidic species. Therefore, the distribution of acidic, basic and main species is similar for the three antibodies but the engineered antibodies P1-068761 and P1-068767 have significantly lower isoelectric point than the parental P1-061029 antibody.

The oligomeric state of P1-061029, P1-068761, and P1-068767 wasere determined over the pH range of 3-9 using dynamic light scattering (DLS) in buffers of different pH. All hydrodynamic radius (Rh) values for each antibody were in the range of 4.8-5.7 nM, which is typical for monomeric antibody samples, Table 17. This suggests that these antibodies do not form detectable levels of high molecular weight aggregated species at 1 mg/ml within the first hour after dilution into formulations having pH between 3-9.

TABLE 17

The hydrodynamic radius as determined by DLS for 1 mg/ml samples of anti-VISTA antibodies across the pH range of pH 3-pH 9.

| pH | Buffer | Rh (nm) P1-061029 | Rh (nm) P1-068761 | Rh (nm) P1-068767 |
|---|---|---|---|---|
| 9 | 20 mM Tris/1 X PBS | 5.2 | 4.8 | 5.2 |
| 8 | 20 mM Tris/1 X PBS | 5.2 | 5.2 | 5.2 |
| 7 | 20 mM Tris/1 X PBS | 4.8 | 5.2 | 5.2 |
| 7 | 20 mM citrate/1 X PBS | 4.8 | 5.2 | 5.7 |
| 6 | 20 mM citrate/1 X PBS | 5.2 | 5.2 | 4.8 |
| 5 | 20 mM citrate/1 X PBS | 5.2 | 4.8 | 5.2 |
| 4 | 20 mM citrate/1 X PBS | 4.8 | 4.8 | 5.2 |
| 3 | 20 mM citrate/1 X PBS | 5.2 | 5.2 | 5.2 |

The thermal stability of P1-061029, P1-068761, and P1-068767 was measured over the pH range of 3-9 by monitoring fluorescence and static light scattering as a function of temperature in buffers of different pH. The first thermal denaturation transition (Tm1) which typically represents denaturation of the CH2 domain of IgG1 antibodies was determined by fluorescence and is shown in Table 18, and the onset of aggregation (Tagg) which typically represents denaturation of the FAB domain of IgG1 antibodies was measured by static light scattering and is shown in Table 19. At neutral pH (pH 7.0) in Tris/PBS formulation the Tm1 values for the three antibodies were P1-061029 (67.4° C.), P1-068761 (67.0° C.), and P1-068767 (65.3° C.), with Tagg values of P1-061029 (67.8° C.), P1-068761 (67.5° C.), and P1-068767 (65.8° C.). The Tm1 for each antibody in Citrate/PBS formulation at the same neutral pH 7.0 or slightly more acidic pH of 6.0 were all within 0.7° of the Tris/PBS pH 7.0 values. However, Tm1 values were slightly lower (between 0.3°-1.1° lower) at more basic pH of 8-9, and significantly lower at more acidic pH of 3-5, for each antibody. Compared to neutral pH, the Tagg for P1-061029 was within 0.1° of pH 7.0 value at more basic pH 8.0-9.0, was 1.0° lower at pH 5.0, and much lower (6.10-19.6° lower) at the most acidic pH conditions pH 3.0-4.0. The Tagg for P1-068761 and P1-068767 were also significantly lower at pH 3.0-4.0. However at pH 5.0 the Tagg for P1-068761 was only 0.2° lower than Tagg at pH 6.0, whereas Tagg for P1-068767 was 2.2° lower at pH 5.0 than at pH 6.0, demonstrating some differences in Tagg for each antibody, Table 19.

TABLE 18

Thermal stability (Tm1 values) for P1-061029, P1-068761, P1-068767 across the pH range of pH 3-pH 9 as determined by fluorescence spectroscopy

| pH | Buffer | Tm1 (° C.) P1-061029 | Tm1 (° C.) P1-068761 | Tm1 (° C.) P1-068767 |
|---|---|---|---|---|
| 9 | 20 mM Tris/1 X PBS | 66.6 | 65.9 | 65.0 |
| 8 | 20 mM Tris/1 X PBS | 67.0 | 66.5 | 64.8 |
| 7 | 20 mM Tris/1 X PBS | 67.4 | 67.0 | 65.3 |
| 7 | 20 mM citrate/1 X PBS | 67.2 | 66.9 | 64.8 |
| 6 | 20 mM citrate/1 X PBS | 67.6 | 67.5 | 65.0 |
| 5 | 20 mM citrate/1 X PBS | 64.4 | 64.7 | 62.1 |
| 4 | 20 mM citrate/1 X PBS | 51.8 | 52.0 | 50.8 |
| 3 | 20 mM citrate/1 X PBS | 30.7 | 28.1 | 28.7 |

TABLE 19

Thermal stability (Tagg values) for P1-061029, P1-068761, P1-068767 across the pH range of pH 3-pH 9 as determined by static light scattering

| pH | Buffer | Tagg (° C.) P1-061029 | Tagg (° C.) P1-068761 | Tagg (° C.) P1-068767 |
|---|---|---|---|---|
| 9 | 20 mM Tris/1 X PBS | 67.7 | 67.1 | 66.0 |
| 8 | 20 mM Tris/1 X PBS | 67.8 | 67.5 | 65.8 |
| 7 | 20 mM Tris/1 X PBS | 67.8 | 68.2 | 65.9 |
| 7 | 20 mM citrate/1 X PBS | 67.8 | 68.1 | 65.7 |
| 6 | 20 mM citrate/1 X PBS | 68.1 | 68.9 | 65.6 |
| 5 | 20 mM citrate/1 X PBS | 66.8 | 68.7 | 63.7 |
| 4 | 20 mM citrate/1 X PBS | 61.7 | 63.6 | 56.9 |
| 3 | 20 mM citrate/1 X PBS | 48.2 | 48.8 | 41.0 |

The apparent viscosity of P1-061029, P1-068761, and P1-068767 was measured using a bead-based DLS method which measures the diffusion rate of polystyrene beads in the presence of formulated antibody solutions. Comparison of all three antibodies at 44 mg/ml shows similar viscosity for both engineered antibodies as the parent antibody under these conditions, Table 20. In a second study additional protein material for P1-068761 and P1-068767 was concentrated to higher concentrations to analyze viscosity at 136 mg/ml, 100 mg/ml, and 50 mg/ml. These data show increased apparent viscosity at higher antibody concentrations, with maximum apparent viscosity of 5.7±0.7 for P1-068761 and 5.3±0.6 for P1-068767 at 136 mg/ml.

TABLE 20

Apparent viscosity (in cP) for antibodies in 20 mM histidine, 260 mM sucrose pH 6.0 at 25° C. as determined by bead based DLS method. Values represent the average and standard deviation of data from three UNi lanes

| Antibody | Apparent Viscosity (cP) @ 136 mg/ml | Apparent Viscosity (cP) @ 100 mg/ml | Apparent Viscosity (cP) @ 50 mg/ml | Apparent Viscosity (cP) @ 44 mg/ml |
|---|---|---|---|---|
| P1-061029 | | | | 1.6 ± 0.1 |
| P1-068761 | 5.7 ± 0.7 | 3.1 ± 0.0 | 1.4 ± 0.2 | 1.5 ± 0.4 |
| P1-068767 | 5.3 ± 0.6 | 3.0 ± 0.3 | 1.7 ± 0.2 | 1.6 ± 0.2 |

The physical stability of 50 mg/ml samples of P1-061029, P1-068761, and P1-068767 in 20 mM histidine, 260 mM sucrose pH 6.0 was studied under accelerated stress conditions of 40° C. for 4 weeks. The oligomeric state of the antibodies was monitored by aSEC for samples immediately prior to 40° C. incubation (time zero=t0), as well as after 1 week (1w) and 4 weeks (4w) of 40° C. stress. These data show that all three antibodies remain more than 96% monomeric after 4 weeks at 40° C., with low levels of HMW species (<1.6% HMW) and low levels of LMW species (<2.0% LMW), Table 21.

TABLE 21 aSEC data for anti-VISTA antibody accelerated stability samples, showing the percentage of high molecular weight species (% HMW), percentage of monomeric/main species (% Main) and percentage of low molecular weight species (% LMW), for t0, 1 w, and 4 w samples

| Antibody | Sample | % HMW | % Main | % LMW |
|---|---|---|---|---|
| P1-061029 | t0 | 0.4 | 99.7 | 0.0 |
| | 1 w | 0.5 | 99.4 | 0.2 |
| | 4 w | 0.8 | 97.2 | 2.0 |
| P1-068761 | t0 | 0.6 | 99.4 | 0.0 |
| | 1 w | 0.9 | 98.8 | 0.3 |
| | 4 w | 1.6 | 96.4 | 2.0 |
| P1-068767 | t0 | 0.5 | 99.5 | 0.0 |
| | 1 w | 0.8 | 98.9 | 0.3 |
| | 4 w | 1.6 | 96.4 | 2.0 |

Example 17: Generation of Anti-VISTA Antibodies with Germline Heavy Chain Framework Region Substitutions Anti-VISTA antibodies P1-061029 or progeny thereof, specifically P1-068761, P1-068767, P1-068761_E55A (P1-070868), P1-068767 D52N (P1-070906), P1-068767_E55A (P1-070908) and P1-068767_D52N_E55A (P1-070916), were prepared in which the heavy chain variable region framework regions were modified by one or both of K16R and T84A substitutions. (In other words, antibody P1-070868 has the amino acid sequences of the VH and VL of antibody P1-068761 E55A but with the K16R and T84A substitutions in the heavy chain framework region.) These substitutions were made so that the antibodies more closely resemble the heavy chain framework region germline sequence, which comprises residues 16R and 84A. FIG. 14 provides an alignment showing the location of each of these amino acid residues relative to the VH of P1-068761 and to its CDR sequences. K16R and T84A substitutions in the VH of P1-068761 and other antibodies are depicted in the Sequence Table.

These substitutions alter the amino acid residues at those two positions such that they contain the same amino acids as in those in the germline from which the '029 heavy chain is derived. The 16R and 84A residues are also present in P1-61015 VH framework regions (see SEQ ID NO: 95).

Binding to hVISTA of these antibodies was measured as described in Example 9. The results are provided in Table 22, and the amino acid substitutions of the antibodies are shown in Table 23. The results indicate that K16R and T84A do not significantly affect the binding kinetics of the '029 progeny.

Therefore, any of the anti-hVISTA antibodies described herein may comprise K16R and/or T84A. Antibodies P1-061029_F10fE_V102D (P1-072000); P1-061029_F100fE (P1-072002); P1-061029_V102D (P1-072004); P1-061029_Y32E (P1-072006) and P1-061029_Y32E_F100fE (P1-072008) with K16R and/or T84A will be constructed and their binding tested as described herein.

TABLE 22

Kinetics of binding of selected Abs to hVISTA

| ID | Description | pH 7.4 ka (1/Ms) | pH 7.4 kd (1/s) | pH 7.4 KD (M) |
|---|---|---|---|---|
| P1-071757 | P1-061029_HC_K16R_T84A (FW revertant) | 1.3E+05 | 5.9E−03 | 4.5E−08 |
| P1-071759 | P1-061029_HC_K16R (FW revertant) | 1.3E+05 | 6.0E−03 | 4.6E−08 |
| P1-071761 | P1-061029_HC_T84A (FW revertant) | 1.5E+05 | 6.0E−03 | 4.0E−08 |
| P1-071763 | P1-068761_HC_K16R_T84A (FW revertant) | No binding at 100 nM | | |
| P1-071765 | P1-068761_HC_K16R (FW revertant) | No binding at 100 nM | | |
| P1-071767 | P1-068761_HC_T84A (FW revertant) | No binding at 100 nM | | |
| P1-071769 | P1-068767_HC_K16R_T84A (FW revertant) | No binding at 100 nM | | |
| P1-071771 | P1-068767_HC_K16R (FW revertant) | No binding at 100 nM | | |
| P1-071773 | P1-068767_HC_T84A (FW revertant) | No binding at 100 nM | | |
| P1-071775 | P1-070868_HC_K16R_T84A (FW revertant) | No binding at 100 nM | | |
| P1-071777 | P1-070868_HC_K16R (FW revertant) | No binding at 100 nM | | |
| P1-071779 | P1-070868_HC_T84A (FW revertant) | No binding at 100 nM | | |
| P1-071781 | P1-070906_HC_K16R_T84A (FW revertant) | No binding at 100 nM | | |
| P1-071783 | P1-070906_HC_K16R (FW revertant) | No binding at 100 nM | | |
| P1-071785 | P1-070906_HC_T84A (FW revertant) | No binding at 100 nM | | |
| P1-071787 | P1-070908_HC_K16R_T84A (FW revertant) | No binding at 100 nM | | |
| P1-071789 | P1-070908_HC_K16R (FW revertant) | No binding at 100 nM | | |
| P1-071791 | P1-070908_HC_T84A (FW revertant) | No binding at 100 nM | | |
| P1-071793 | P1-070916_HC_K16R_T84A (FW revertant) | No binding at 100 nM | | |
| P1-071795 | P1-070916_HC_K16R (FW revertant) | No binding at 100 nM | | |
| P1-071797 | P1-070916_HC_T84A (FW revertant) | No binding at 100 nM | | |
| P1-072000 | P1-061029_F100fE_V102D | No binding at 100 nM | | |
| P1-072002 | P1-061029_F100fE | 4.4E+04 | 8.5E−03 | 1.9E−07 |
| P1-072004 | P1-061029_V102D | No binding at 100 nM | | |
| P1-072006 | P1-061029_Y32E | 1.2E+04 | 6.3E−03 | 5.4E−07 |
| P1-072008 | P1-061029_Y32E_F100fE | No binding at 100 nM | | |
| P1-070916 | P1-068767_D52N_E55A | No binding at 100 nM | | |
| P1-070908 | P1-068767_E55A | No binding at 100 nM | | |
| P1-070906 | P1-068767_D52N | No binding at 100 nM | | |
| P1-070868 | P1-068761_E55A | No binding at 100 nM | | |
| P1-0687677 | acidic pH selective progeny '767 | No binding at 100 nM | | |
| P1-0687617 | acidic pH selective progeny '767 | No binding at 100 nM | | |
| P1-0610296 | GI parent | 1.8E+05 | 6.4−03 | 3.6−08 |

| ID | pH 6.0 ka (1/Ms) | pH 6.0 kd (1/s) | pH 6.0 KD (M) |
|---|---|---|---|
| P1-071757 | 8.1E+05 | 5.9E−03 | 7.3E−09 |
| P1-071759 | 8.0E+05 | 5.9E−03 | 7.4E−09 |

TABLE 22-continued

| \multicolumn{4}{|c|}{Kinetics of binding of selected Abs to hVISTA} |
|---|---|---|---|
| P1-071761 | 8.7E+05 | 6.0E−03 | 6.9E−09 |
| P1-071763 | 2.9E+05 | 1.4E−03 | 4.9E−09 |
| P1-071765 | 2.8E+05 | 1.4E−03 | 5.0E−09 |
| P1-071767 | 3.1E+05 | 1.6E−03 | 5.1E−09 |
| P1-071769 | 2.4E+05 | 2.6E−03 | 1.1E−08 |
| P1-071771 | 2.5E+05 | 2.6E−03 | 1.1E−08 |
| P1-071773 | 2.7E+05 | 2.6E−03 | 9.8E−09 |
| P1-071775 | 2.5E+05 | 1.7E−03 | 6.9E−09 |
| P1-071777 | 2.7E+05 | 1.7E−03 | 6.4E−09 |
| P1-071779 | 2.6E+05 | 1.8E−03 | 7.0E−09 |
| P1-071781 | 2.2E+05 | 1.7E−03 | 7.7E−09 |
| P1-071783 | 2.2E+05 | 1.7E−03 | 7.6E−09 |
| P1-071785 | 2.5E+05 | 1.7E−03 | 6.7E−09 |
| P1-071787 | 2.1E+05 | 2.7E−03 | 1.3E−08 |
| P1-071789 | 2.1E+05 | 2.6E−03 | 1.3E−08 |
| P1-071791 | 2.4E+05 | 2.7E−03 | 1.1E−08 |
| P1-071793 | 2.1E+05 | 1.7E−03 | 8.1E−09 |
| P1-071795 | 2.1E+05 | 1.7E−03 | 8.1E−09 |
| P1-071797 | 2.2E+05 | 1.7E−03 | 7.7E−09 |
| P1-072000 | 2.0E+05 | 2.3E−03 | 1.2E−08 |
| P1-072002 | 6.5E+05 | 1.6E−03 | 2.5E−09 |
| P1-072004 | 1.4E+05 | 2.5E−02 | 1.8E−07 |
| P1-072006 | 3.4E+05 | 1.2E−03 | 3.5E−09 |
| P1-072008 | 2.7E+05 | 2.4E−02 | 8.8E−08 |
| P1-070916 | 2.3E+05 | 1.7E−03 | 7.4E−09 |
| P1-070908 | 2.2E+05 | 2.5E−03 | 1.1E−08 |
| P1-070906 | 2.4E+05 | 1.6E−03 | 6.7E−09 |
| P1-070868 | 2.6E+05 | 1.8E−03 | 7.0E−09 |
| P1-0687677 | 2.6E+05 | 2.6E−03 | 1.0E−08 |
| P1-0687617 | 2.8E+05 | 1.5E−03 | 5.5E−09 |
| P1-0610296 | 7.8E+05 | 5.8E−03 | 7.4E−09 |

TABLE 23

Amino acid sequences of the VH CDRs of the antibodies of Table 22

| ID | Description | HCDR1 | HCDR2 | HCDR3 | LCDR1 | LCDR2 | LCDR3 |
|---|---|---|---|---|---|---|---|
| P1-071757 | P1-061029_HC_K16R_T84A (FW revertant) | .......... | ...... .... | .............. | .............. | ........ | ..... .... |
| P1-071759 | P1-061029_HC_K16R (FW revertant) | .......... | ...... .... | .............. | .............. | ........ | ..... .... |
| P1-071761 | P1-061029_HC_T84A (FW revertant) | .......... | ...... .... | .............. | .............. | ........ | ..... .... |
| P1-071763 | P1-068761_HC_K16R_T84A (FW revertant) | ....E.E... | ......EE..... .... | .....H.....E.. | .............. | ........ | ..... .... |
| P1-071765 | P1-068761_HC_K16R (FW revertant) | ....E.E... | ......EE..... .... | .....H.....E.. | .............. | ........ | ..... .... |
| P1-071767 | P1-068761_HC_T84A (FW revertant) | ....E.E... | ......EE..... .... | .....H.....E.. | .............. | ........ | ..... .... |
| P1-071769 | P1-068767_HC_K16R_T84A (FW revertant) | ....E..... | ..D...E...... .... | ..........E.D | .............. | ........ | ..... .... |
| P1-071771 | P1-068767_HC_K16R (FW revertant) | ....E..... | ..D...E...... .... | ..........E.D | .............. | ........ | ..... .... |
| P1-071773 | P1-068767_HC_T84A (FW revertant) | ....E..... | ..D...E...... .... | ..........E.D | .............. | ........ | ..... .... |
| P1-071775 | P1-070868_HC_K16R_T84A (FW revertant) | ....E.E... | ......E..... .... | .....H.....E.. | .............. | ........ | ..... .... |
| P1-071777 | P1-070868_HC_K16R (FW revertant) | ....E.E... | ......E..... .... | .....H.....E.. | .............. | ........ | ..... .... |

TABLE 23-continued

Amino acid sequences of the VH CDRs of the antibodies of Table 22

| ID | Description | HCDR1 | HCDR2 | HCDR3 | LCDR1 | LCDR2 | LCDR3 |
|---|---|---|---|---|---|---|---|
| P1-071779 | P1-070868_HC_T84A (FW revertant) | ....E.E... | ......E..... .... | .....H.....E.. | ............. | ........ | .... |
| P1-071781 | P1-070906_HC_K16R_T84A (FW revertant) | ....E..... | ......E...... .... | ..........E.D | ............. | ........ | .... |
| P1-071783 | P1-070906_HC_K16R (FW revertant) | ....E..... | ......E...... .... | ..........E.D | ............. | ........ | .... |
| P1-071785 | P1-070906_HC_T84A (FW revertant) | ....E..... | ......E...... .... | ..........E.D | ............. | ........ | .... |
| P1-071787 | P1-070908_HC_K16R_T84A (FW revertant) | ....E..... | ..D.......... .... | ..........E.D | ............. | ........ | .... |
| P1-071789 | P1-070908_HC_K16R (FW revertant) | ....E..... | ..D.......... .... | ..........E.D | ............. | ........ | .... |
| P1-071791 | P1-070908_HC_T84A (FW revertant) | ....E..... | ..D.......... .... | ..........E.D | ............. | ........ | .... |
| P1-071793 | P1-070916_HC_K16R_T84A (FW revertant) | ....E..... | .............. .... | ..........E.D | ............. | ........ | .... |
| P1-071795 | P1-070916_HC_K16R (FW revertant) | ....E..... | .............. .... | ..........E.D | ............. | ........ | .... |
| P1-071797 | P1-070916_HC_T84A (FW revertant) | ....E..... | .............. .... | ..........E.D | ............. | ........ | .... |
| P1-072000 | P1-061029_F100fE_V102D | .......... | .............. .... | ..........E.D | ............. | ........ | .... |
| P1-072002 | P1-061029_F100fE | .......... | .............. .... | ..........E.. | ............. | ........ | .... |
| P1-072004 | P1-061029_V102D | .......... | .............. .... | .............D | ............. | ........ | .... |
| P1-072006 | P1-061029_Y32E | ......E... | .............. .... | .............. | ............. | ........ | .... |
| P1-072008 | P1-061029_Y32E_F100fE | ......E... | .............. .... | ..........E.. | ............. | ........ | .... |
| P1-070916 | P1-068767_D52N_E55A | .....E..... | .............. .... | ..........E.D | ............. | ........ | .... |
| P1-070908 | P1-068767_E55A | .....E..... | ..D........... .... | ..........E.D | ............. | ........ | .... |
| P1-070906 | P1-068767_D52N | .....E..... | ......E....... .... | ..........E.D | ............. | ........ | .... |
| P1-070868 | P1-068761_E55A | .....E.E... | .......E..... .... | ....H.....E.. | ............. | ........ | .... |
| P1-0687677 | acidic pH selective progeny '767 | .....E..... | ..D...E....... .... | ..........E.D | ............. | ........ | .... |
| P1-0687617 | acidic pH selective progeny '761 | .....E.E... | .......EE..... .... | ....H.....E.. | ............. | ........ | .... |
| P1-0610296 | GI parent | GFTLDDYAME | GINWNSANIGYAD SVKG | VPGYSGGWIDAFDV | RASQSVSSSYLA | GASSRAT | QQYGSSPFT |

Thus, this Example identified anti-human VISTA antibodies that bind to human VISTA with 200-10,000 fold greater affinity at acidic pH than at physiological pH. In cell binding assays, these acidic pH-selective VISTA antibodies exhibited an inflection point in binding intensity at approximately pH 6.5, similar to what was observed for the binding of VISTA to T cells.

Example 18: Anti-VISTA Antibody and Anti-PD-1 Antibody Act Synergistically to Elicit Tumor Rejection To characterize the effects of blocking VISTA's acidic pH-selective ligand interface in a tumor, a mouse surrogate antibody, VISTA.10, was produced, which blocks mouse VISTA binding to mouse T cells at acidic pH. (VISTA.10 also binds mVISTA at physiological pH.) To avoid Fc receptor engagement and any subsequent effector functions, VISTA.10 was converted to an IgG1 isotype with a point mutation, D265A, to avoid Fc receptor engagement and effector functions {Clynes, 2000}. MC38 tumors were implanted subcutaneously in mice, and when the tumors reached about 70 $mm^2$, the following treatments were administered every three days to the mice: Group 1:4 doses of anti-KLH mIgG1-D265A at 30 mpk; Group 2: two doses of anti-PD-1 mIgG1-D265A at 5 mg/kg; Group 3:4 doses of anti-VISTAmIgG1-D265A at 30 mg/kg; and Group4: anti-PD-1+anti-VISTA combination. Combination treatment of VISTA.10 and a PD-1 blocking antibody elicited tumor rejection in most mice implanted with MC38 colorectal adenocarcinoma tumors (FIG. 15A-D) anti-PD-1 and VISTA.10 single agent treatments modestly delayed, but did not prevent, tumor progression (FIG. 15A-D).

Figure 15H:
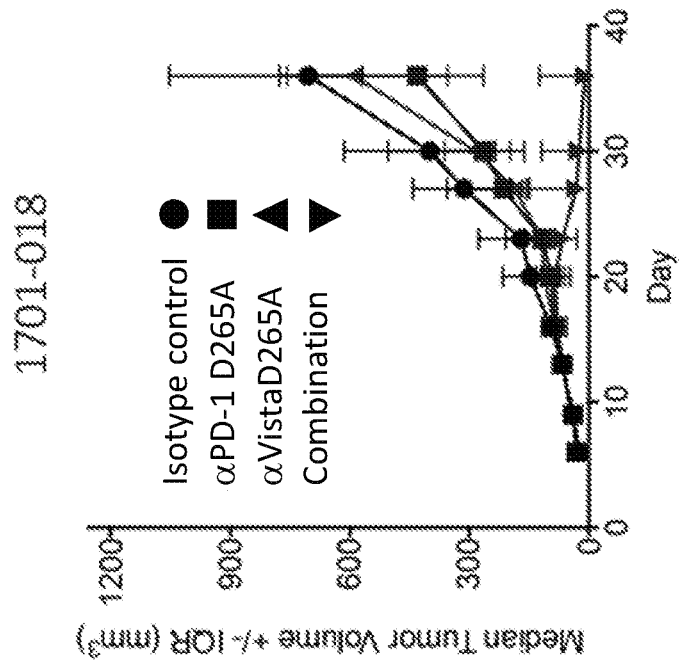
Figure 15G:
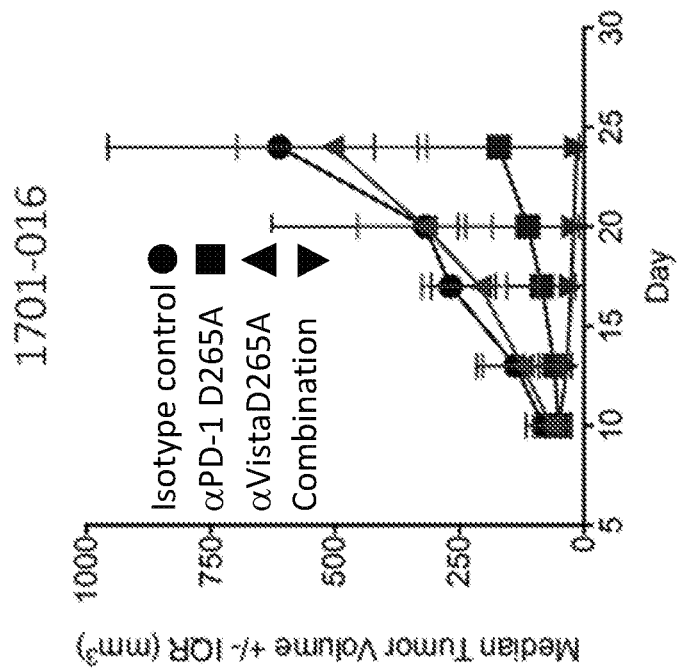
FIGS. 15G and H show results for individual mice shown in FIGS. 15A-D.

Consistent with these results, ex vivo analysis of tumors from treated mice showed 5- and 10-fold increases in the frequencies of tumor-infiltrating CD8+ T cells and CD4+ T cells, respectively, in mice treated with VISTA.10 and anti-PD-1 (FIG. 15E-F). Other leukocyte subsets were largely unaffected. Combination therapy also resulted in significantly lower expression of PD-1, LAG-3 and TIM-3, all markers of T cell exhaustion and dysfunction, on tumor-infiltrating CD8+ T cells (FIG. 15E). Treatment with PD-1 or VISTA antibodies alone had only modest effects on T cell frequencies and phenotype (FIGS. 15E-F). Intratumoral myeloid cell subset frequencies, including those of macrophages, monocytic myeloid-derived suppressor cells (MDSC), and granulocytic MDSC, were largely unaffected by VISTA antibody treatment.

Figure 15I:
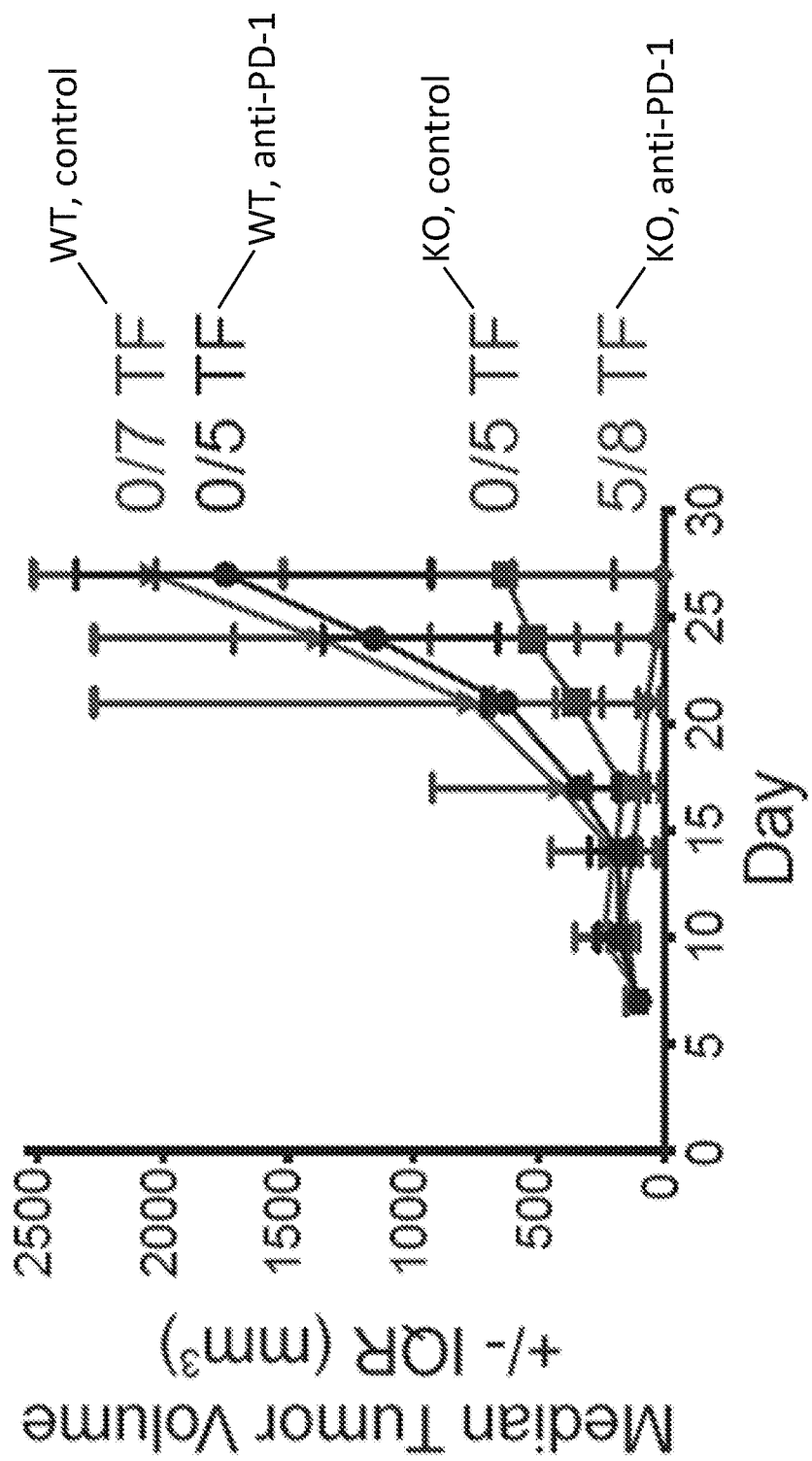
FIG. 15I: VISTA knockout mice and wildtype littermates were implanted with MC38 tumors and treated with non-binding isotype-matched control antibodies (upper two curves (0/7 TF and 0/5 TF, marked with circles and downward triangles) or with a mouse PD-1 blocking antibody (lower two curves 0/5 TF and 5/8 TF, marked with squares and downward triangles). Median tumor growth and the number of mice that were tumor-free (TF) at the end of the study vs. the total number of mice are shown next to each curve (e.g, 0/7 TF). These data are representative of two independent experiments. Error bars depict the interquartile range.
Figures 15J, 15K:
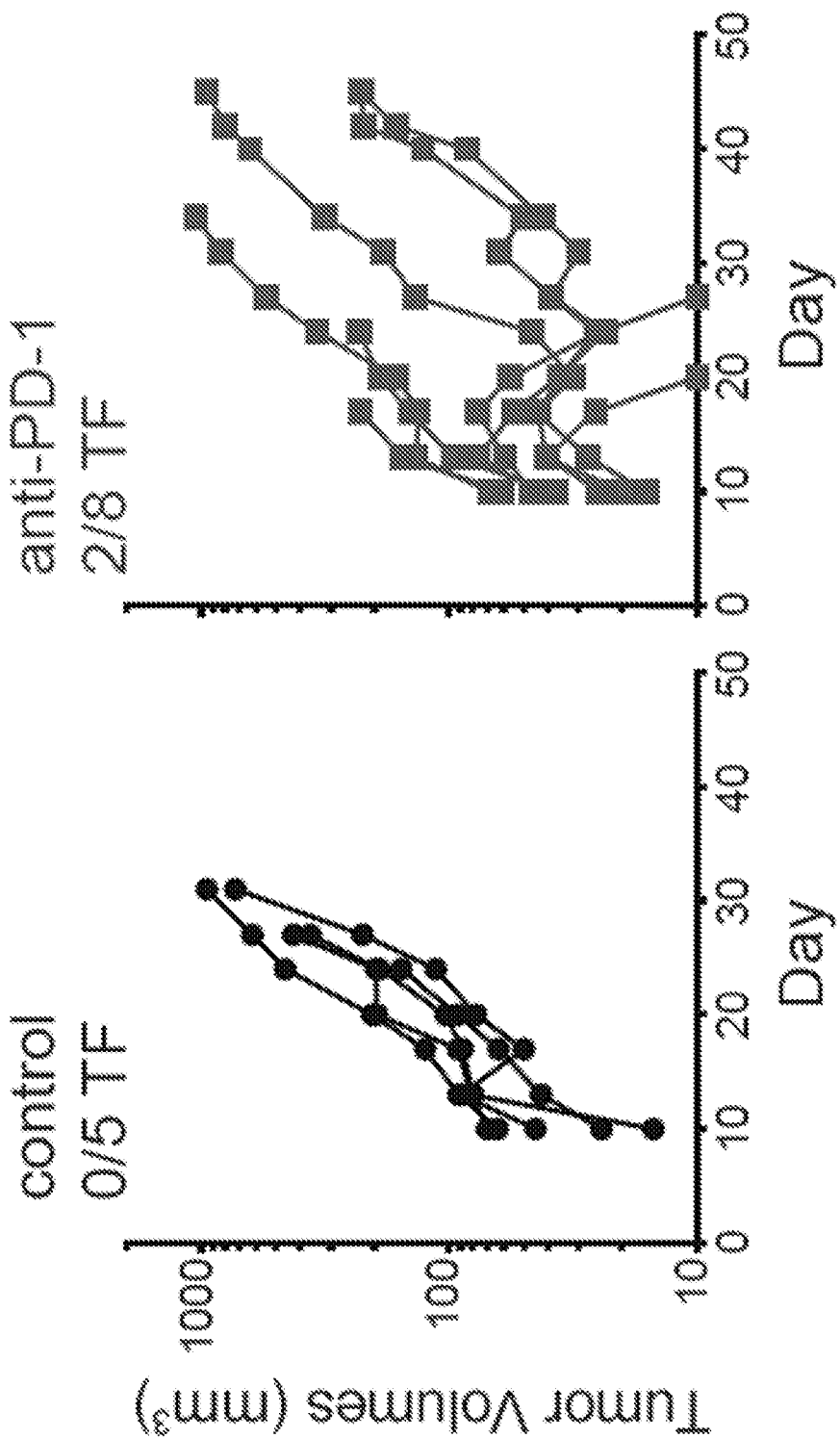
FIGS. 15J-M show the tumor volumes of human VISTA knock-in (KI) mice implanted with MC38 tumors and treated with non-binding isotype-matched control antibodies (FIG. 15J), a mouse PD-1 blocking antibody (FIG. 15K), a combination of mouse PD-1 blocking antibody and the non-pH-selective human VISTA blocking antibody P1-061029 (FIG. 15L), or a combination of mouse PD-1 blocking antibody and the acidic pH-selective human VISTA blocking antibody P1-068767 (FIG. 15M). All antibodies were mouse IgG1-D265A isotype. Tumor volumes over time are shown. n=5-8 per group. These data are representative of one independent experiment.
Figures 15L, 15M:
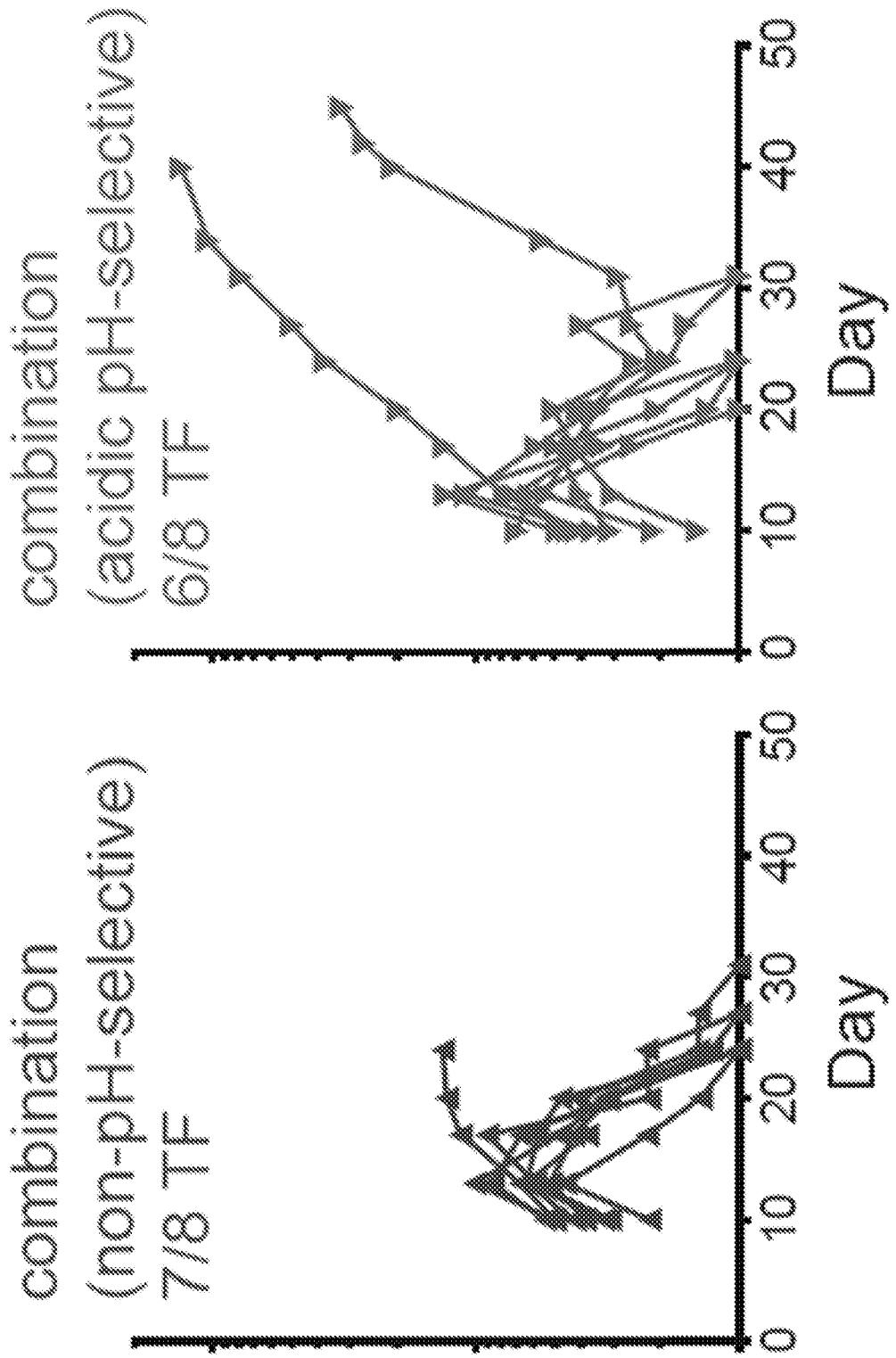
Figure 15O:
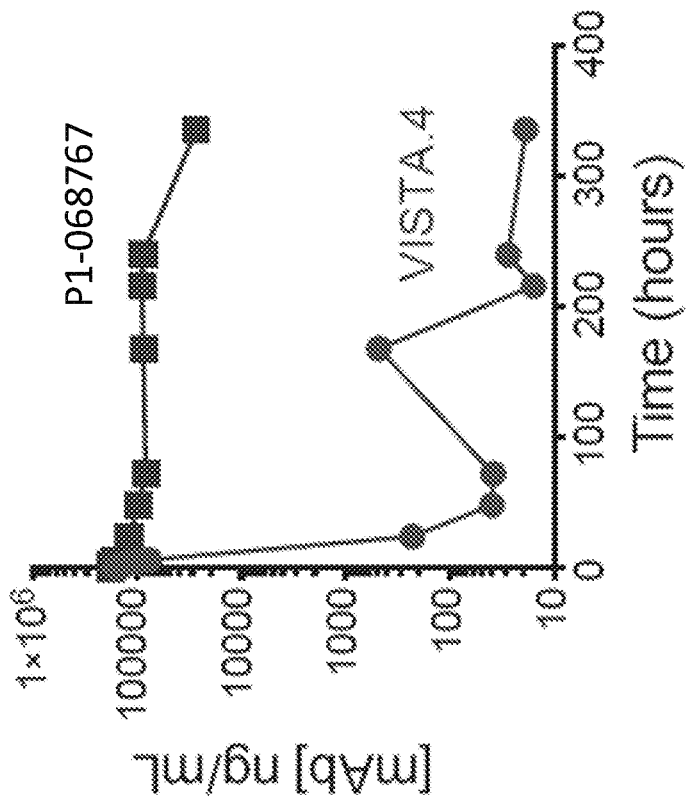

To contextualize VISTA antibody activity, VISTA knockout mice were implanted with MC38 tumors and treated with PD-1 blocking or control antibodies. As shown in FIG. 15I, in the control treatment groups, MC38 tumors grew comparably in VISTA knockout mice and their wildtype littermates. VISTA knockout mice exhibited increased responsiveness to anti-PD-1, reminiscent of VISTA and PD-1 combination efficacy. This responsiveness was again correlated with increased intratumoral CD4+ and CD8+ T cells. These data indicate that antibodies that block VISTA binding at acidic pH are sufficient to reverse VISTA-mediated immune suppression.

Because VISTA functions selectively at acidic pH, we hypothesized that VISTA-mediated suppression of anti-tumor responses occurs predominantly within the tumor beds themselves. We tested the activity of the acidic pH-selective human VISTA blocking antibody P1-068767 ('767) and its non-pH-selective parent antibody P1-061029 ('029) in transgenic mice expressing the human VISTA extracellular domain in place of the endogenous VISTA extracellular domain (human VISTA knock-in mice, genOway). Consistent with the combination and VISTA knockout experiments described above, P1-061029 and P1-068767 elicited comparable efficacy in combination with a mouse PD-1 blocking antibody (FIG. 15J-M).

Figure 15N:
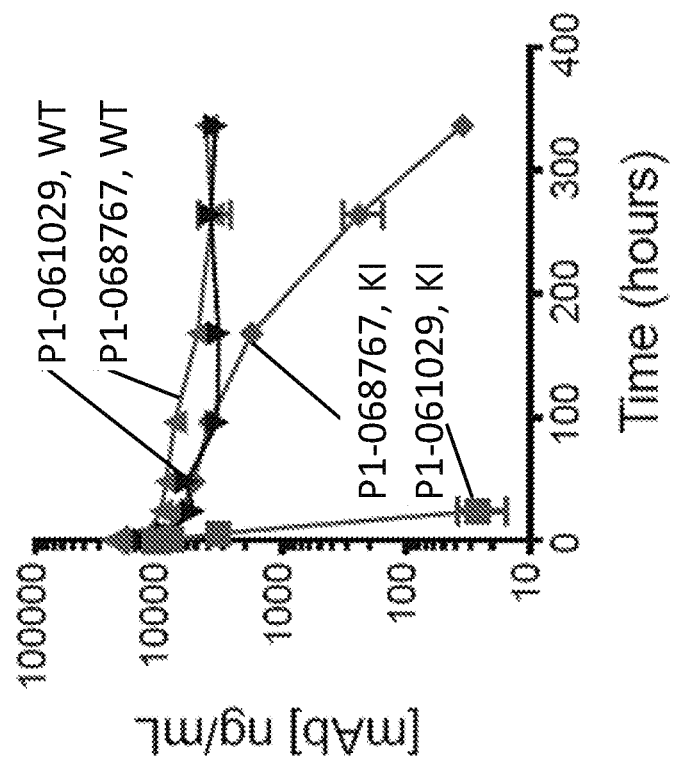
FIG. 15N shows human VISTA KI and wildtype littermate (WT) mouse serum antibody concentrations after intravenous injection of 5 mg/kg of P1-061029 (WT, downward triangles; KI, squares) or P1-068767 (WT, upward triangles; KI, diamonds). The calculated serum mean residence times (MRT) for P1-061029 and P1-068767 in KI mice are estimated to be 4.1 and 71 hours respectively. n=4 KI mice and 1-2 WT mice per antibody. These data are representative of a single experiment.
Figures 16A, 16B, 16C:
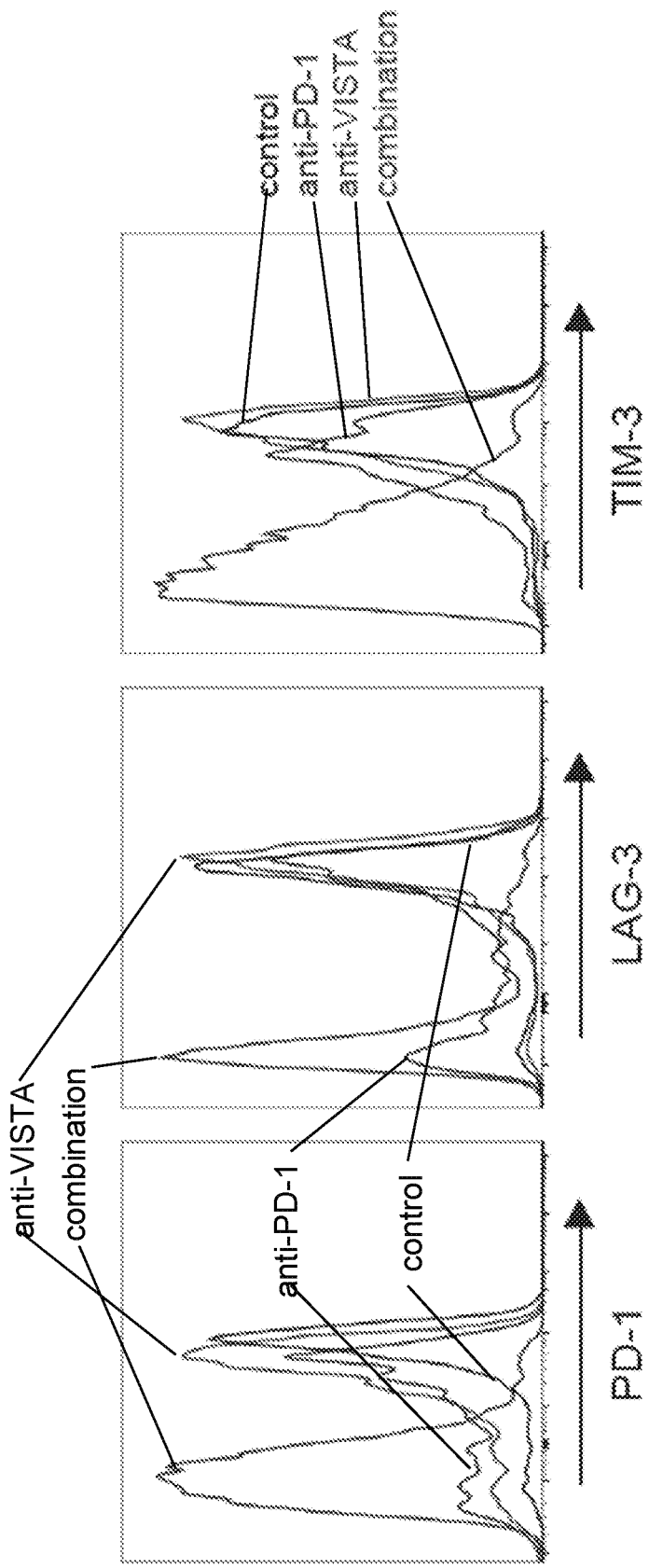
FIGS. 16A-C show representative histograms of intratumoral CD8+ T cell expression of PD-1 (FIG. 16A), LAG-3 (FIG. 16B), and TIM-3 (FIG. 16C) 7 days after the start of treatment. Error bars depict the standard error of the mean.

The half-life of P1-068767 and P1-061029 in the human VISTA knock-in mice was measured. As shown in FIG. 15N, P1-068767 exhibited a nearly 20-fold longer mean residence time (MRT) than did P1-061029, indicative of weak binding to VISTA at pH 7.4 and consequently reduced TMDD (71 hours and 4.1 hours respectively).

To assess antibody engagement of peripheral VISTA in a non-transgenic model, we treated cynomolgus macaques with P1-068767 and a neutral pH-preferring antibody called VISTA.4 (a separate patent application family to the same applicants provides further description of VISTA.4) as follows. VISTA.4 and P1-068767 were evaluated following 10 minute intravenous infusions into protein-naive cynomolgus monkeys at a dose of 5 mg/kg (n=1 per antibody). Serial blood samples were collected at 0.17, 0.5, 2, 4, 6, 24, 48, 72, 168, 216, 240, 336 hours post-infusion. Subsequently, serum samples were obtained for antibody concentration analysis using a ligand-binding assay that employed the recombinant VISTA as a capturing agent and an anti-human IgG Fc mAb as a detecting agent. The lower limit of quantification for the assay was 1 ng/mL. Mean residence times were estimated by non-compartment analysis of the serum mAb concentration-time data using Kinetica software (Version 5.0, Thermo Fisher Scientific). The results show that P1-068767 again exhibited a much longer MRT (717 hours and 7.6 hours respectively, FIG. 60). These results suggest that VISTA blockade in the tumor microenvironment, rather than in the blood and non-acidic tissues, drives anti-tumor efficacy.

Example 19: VISTA.4 Inhibits VISTA Binding to PSGL-1

Imunoreceptor P-selectin glycoprotein ligand-1 (PSGL-1) was identified previously as a VISTA ligand (see, WO2018132476). PSGL-1 is a receptor for selectins, particularly P-selectin, and binding to its primary ligand, P-selectin, is a well characterized facilitator of adhesion interactions between leukocytes, platelets, and endothelial cells (Carlow, D. A., et al., PSGL-1 function in immunity and steady state homeostasis. Immunol Rev, 2009. 230(1): p. 75-96, and Abadier, M. and K. Ley, P-selectin glycoprotein ligand-1 in T cells. Curr Opin Hematol, 2017. 24(3): p. 265-273. 18). PSGL-1 has also been identified as a negative regulator of T cell responses in contexts of chronic viral infection, cancer tumor immunity, and some autoimmune diseases (Angiari, S., et al., Regulatory T cells suppress the late phase of the immune response in lymph nodes through P-selectin glycoprotein ligand-1. J Immunol, 2013. 191(11): p. 5489-500; Matsumoto, M., M. Miyasaka, and T. Hirata, P-selectin glycoprotein ligand-1 negatively regulates T-cell immune responses. J Immunol, 2009. 183(11): p. 7204-11; Nunez-Andrade, N., et al., P-selectin glycoprotein ligand-1 modulates immune inflammatory responses in the enteric lamina propria. J Pathol, 2011. 224(2): p. 212-21; Perez-Frias, A., et al., Development of an autoimmune syndrome affecting the skin and internal organs in P-selectin glycoprotein ligand 1 leukocyte receptor-deficient mice. Arthritis Rheumatol, 2014. 66(11): p. 3178-89; Tinoco, R., et al., PSGL-1 Is an Immune Checkpoint Regulator that Promotes T Cell Exhaustion. Immunity, 2016. 44(5): p. 1190-203). This immunosuppressive function appears to be independent of known PSGL-1 ligands (Tinoco, R., et al., PSGL-1: A New Player in the Immune Checkpoint Landscape. Trends Immunol, 2017. 38(5): p. 323-335).

In cell-based assays, recombinant PSGL-1 and recombinant P-selectin were shown to both be capable of blocking of VISTA multimer binding to activated human CD4+ T cells. Deletion of PSGL-1 from activated CD4+ T cells by CRISPR also ablated VISTA multimer binding. In addition, ectopic expression of PSGL-1 was shown to be sufficient to enable VISTA binding to CHO cells at acidic pH, and VISTA expression was sufficient to enable PSGL-1 binding to 293T cells at acidic pH.

Figure 17A:
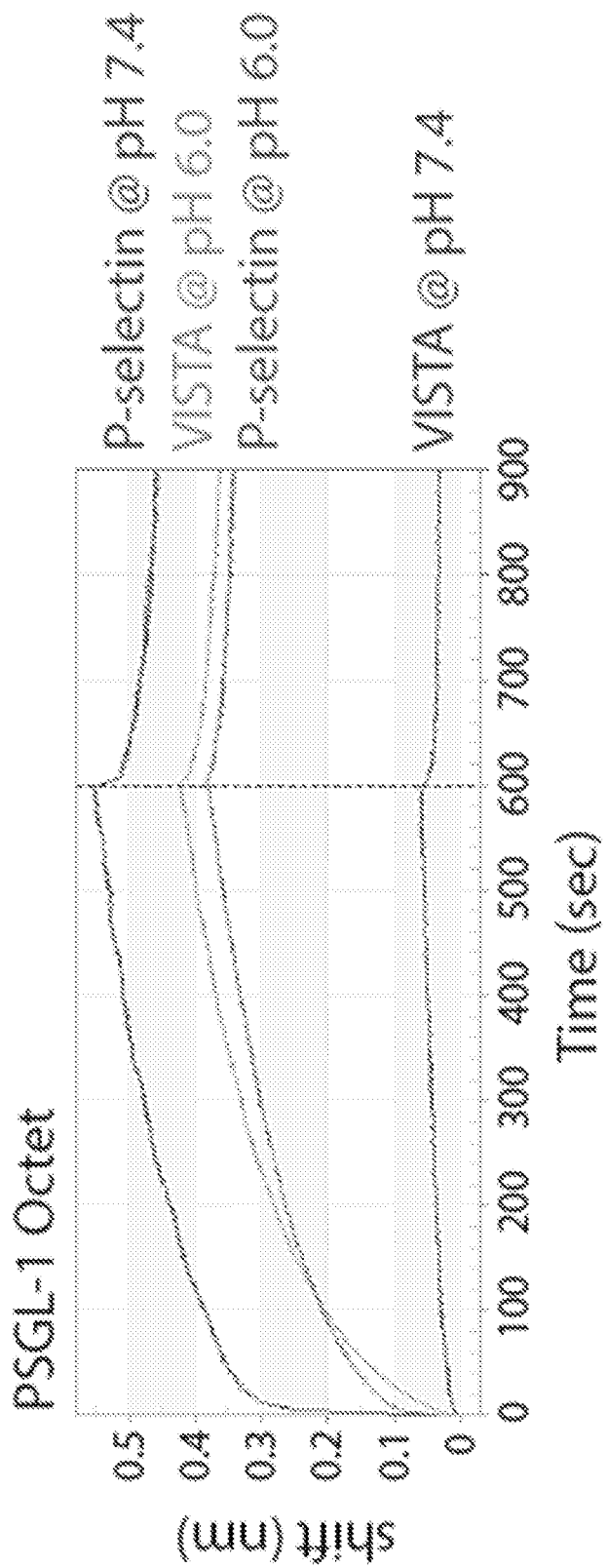
FIGS. 17A-C show that VISTA binds to PSGL-1 at acidic pH and that this interaction is blocked by VISTA antibodies P1-061029, P1-068761, P1-068767 and VISTA.4.

This Example shows that PSGL-1 bound P-selectin comparably at acidic and physiological pH, but bound VISTA only at acidic pH (FIG. 17A). The experiment was conducted using Octet biosensor assays with VISTA, P-selectin, and the minimal PSGL-1 glycopeptide (amino acids 1-19, with both sulfotyrosine and siayl lewis X carbohydrate post-translational modifications) previously shown to support high affinity P-selectin binding (Sako, D., et al., A sulfated peptide segment at the amino terminus of PSGL-1 is critical for P-selectin binding. Cell, 1995. 83(2): p. 323-319).

Figure 25A:
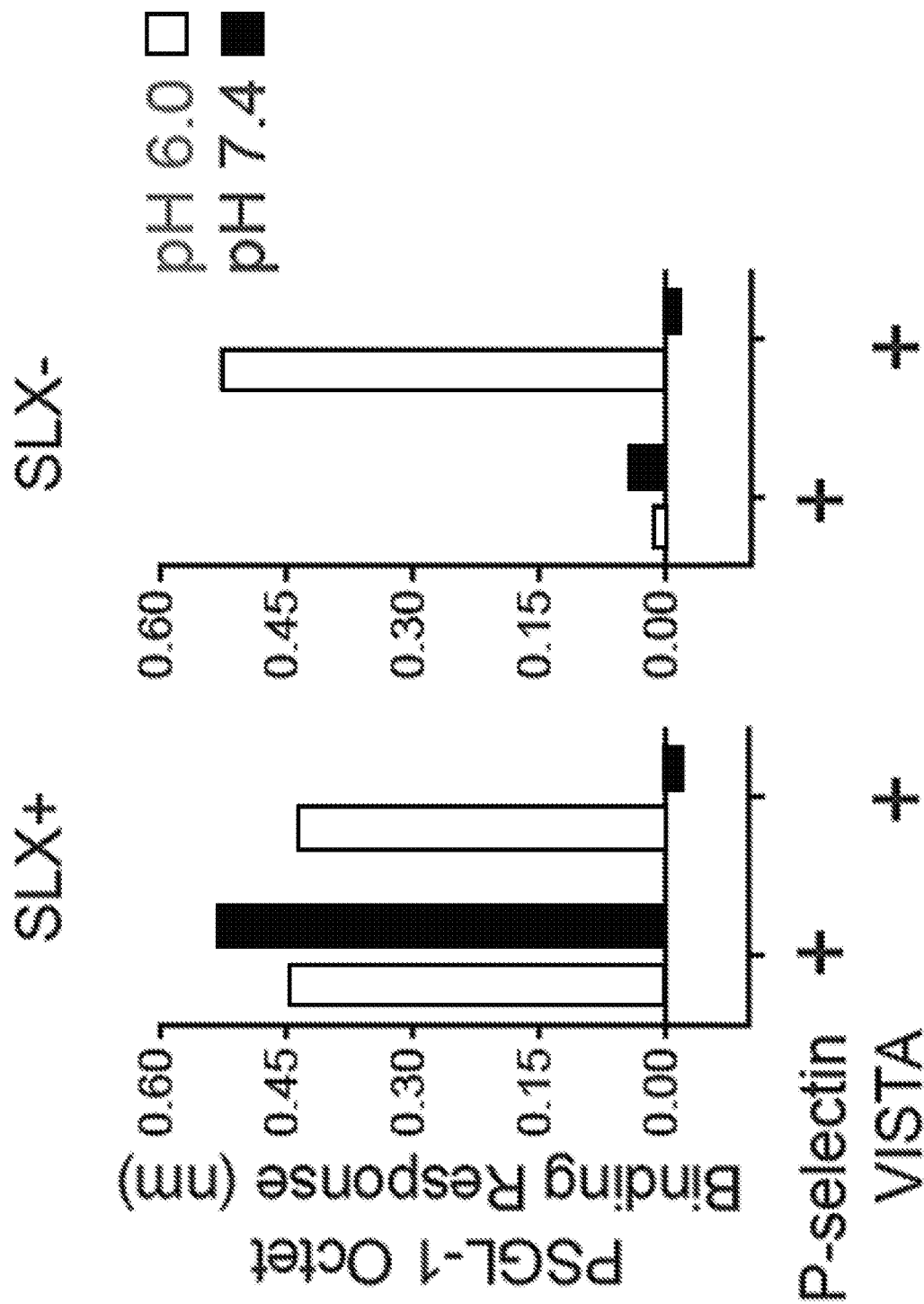
As shown in FIG. 25A, human PSGL-1 19-mer-Fc recombinant proteins were produced in cells with or without sialyl lewis X decoration (SLX+ and SLX-respectively). BLI binding magnitudes at pH 6.0 (white) and 7.4 (black) are shown for VISTA-Fc and P-selectin-Fc as indicated. Data are representative of a single independent experiment.

PSGL-1's ligand interface relies on negatively charged sulfotyrosine and siayl Lewis-X post-translational modifications to bind P-selectin with high affinity (Sako et al. 1995 Cell 83(2): p. 323-319), and naïve T cells, which express non-siayl-lewis-X decorated PSGL-1, are consequently unable to engage P-selectin efficiently. Siayl lewis X-decorated PSGL-1 is constitutively expressed on circulating monocytes and neutrophils, and inducibly expressed on activated T cells, consistent with strong VISTA binding to these cell types at acidic pH. However, VISTA was found to bind to both naïve and activated T cells, suggesting that unlike P-selectin, VISTA binds PSGL-1 independently of siayl lewis X. In additional Octet biosensor assays, it was found that, while VISTA and P-selectin both bound preferentially to PSGL-1 glycopeptides with siayl lewis X decoration, only VISTA bound PSGL-1 glycopeptides without siayl lewis X. In addition, PSGL-1 produced in cells not expressing the enzymes glucosaminyl (N-acetyl) transferase (GCNT1) and alpha (1,3)-fucosyltransferase-7 enzymes (FUT7) lacked sialyl lewis X decoration and bound poorly to P-selectin (FIG. 25A). In contrast, VISTA bound PSGL-1 independently of sialyl lewis X (FIG. 25A). This result is consistent with VISTA, but not P-selectin, binding to naïve T cells which lack sialyl lewis X.

Also similar to P-selectin, VISTA bound modestly to heparan sulfate at acidic pH.

Additionally, PSGL-1 antibodies that block P-selectin binding did not block VISTA binding. These data indicate that VISTA binds a PSGL-1 interface that is similar but distinct from that bound by P-selectin.

This Example further shows that antibodies P1-061029, P1-068761, P1-068767 and VISTA.4, which block VISTA binding to T cells, also blocked VISTA binding to the PSGL-1 glycopeptide.

Figure 17B:
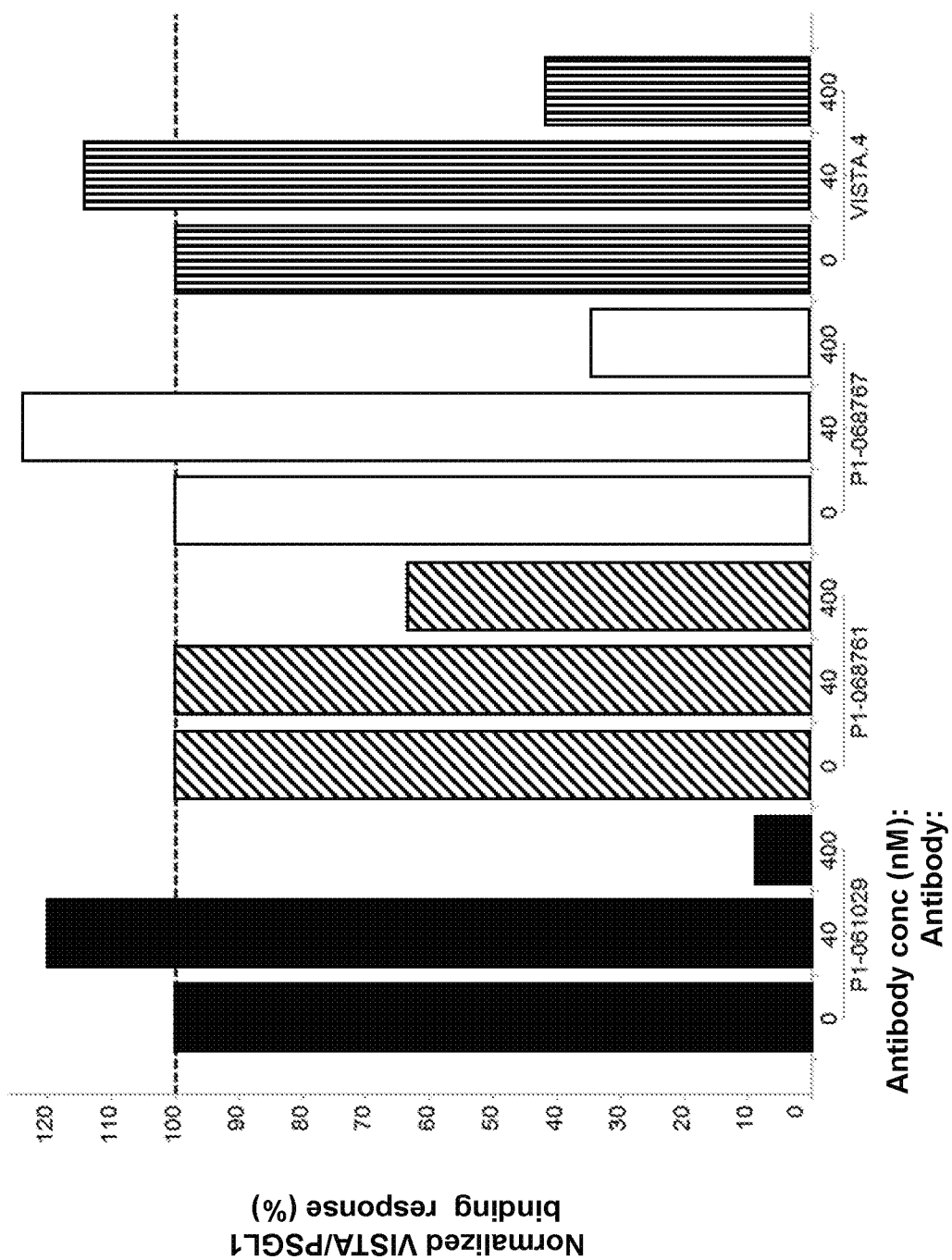

Competitive Octet assays were conducted to evaluate whether acidic pH-selective α-VISTA antibodies P1-068761 and P1-068767, the P1-061029 pH-independent parent, and acidic pH-sensitive VISTA.4 blocked VISTA binding to PSGL1. Binding assays were performed on an OctetRed384 bio-layer interferometry (BLI) instrument (PALL/ForteBio). All assay steps were performed at 30° C. at 1000 rpm shake speed, and the buffer used was PBST, pH 6.0 (137 mM sodium chloride, 2.7 mM potassium chloride, 10 mM phosphate buffer, 0.05% Tween 20). Human VISTA-Fc (R&D Systems #7126-B7) was diluted to 400 nM in PBST pH 6.0 and premixed for 30 minutes with a 0 nM, 40 nM, and 400 nM titration series of P1-068761, P1-068767, P1-061029 and VISTA.4. The human PSGL1 19-mer-huFc protein, consisting of the amino-terminal 19 amino acids of mature PSGL1 fused to human Fc, was captured onto anti-human IgG-Fc sensors (AHC, PALL/ForteBio). The anti-human capture sensors were blocked next with total human IgG (Jackson #009-000-002). Binding of the captured PSGL1 to VISTA-Fc/α-VISTA antibody mixture was measured next to assess whether the α-VISTA antibodies prevented VISTA from binding to PSGL1. For each antibody titration series, the magnitude of VISTA binding to PSGL1 (nm shift) was normalized to the 0 nM unblocked VISTA: PSGL1 response, set at 100%. The results from this assay are summarized in FIG. 17B. In this assay, the 400 nM concentrations of P1-061029, P1-068761, P1-068767 and VISTA.4 all demonstrated blocking activity. The VISTA-Fc protein was prevented from binding to the captured human PSGL1-19-mer-huFc protein, as indicated by the reduced VISTA binding observed.

Figure 17C:
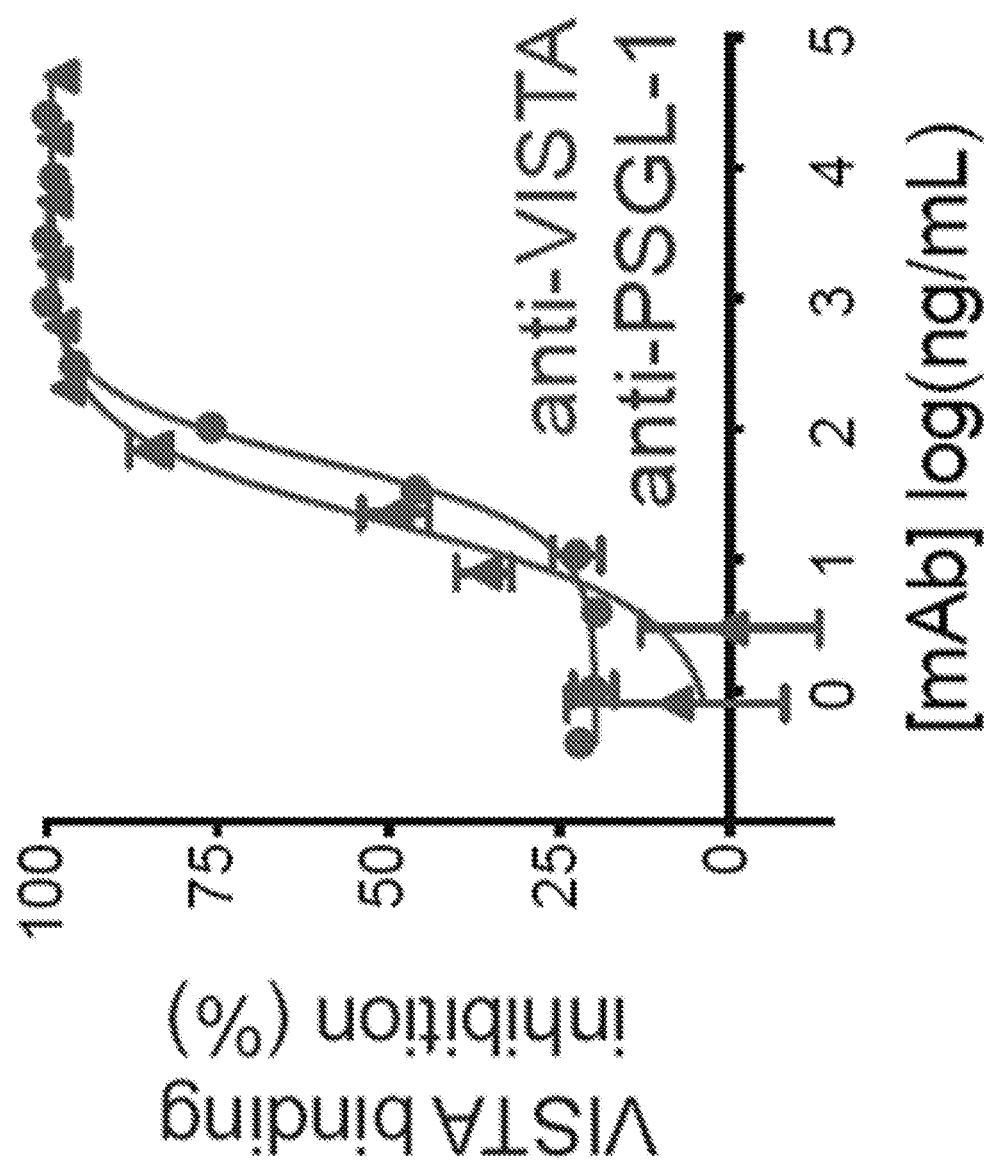

Additionally, it was demonstrated that VISTA binding to CHO-PSGL-1 cells was blocked by both VISTA.4 and the P-selectin-blocking PSGL-1 antibody KPL-1 (FIG. 17C). In PSGL-1 antibody blocking assays, the cells were pre-incubated with KPL-1 (BD Biosciences or Biolegend) or PL2 (MBL) the indicated antibodies prior to labeling with 32 nM-loaded VISTA multimers or VISTA-Fc chimeric proteins. VISTA-Fc binding was detected by anti-IgG (Jackson ImmunoResearch) or anti-6xhis (Columbia Biosciences) antibodies. Cells were acquired by flow cytometry or homogenous time resolved fluorescence (HTRF).

Example 20: Crystal Structure of P1-068767 Bound to hVISTA

Figure 18A:
FIGS. 18A-E show representations of the co-crystal structure of P1-068767 Fab and hVISTA, or (in FIG. 18E) non-blocking antibody VISTA.5 and hVISTA. The VISTA IgV domain features an unusual, histidine-rich extension of its central B-sheet. The VISTA IgV domain was co-crystallized with the P1-068767 Fragment antigen-binding (Fab). The crystal structure of the VISTA+P1-068767 complex was determined at 1.6 Å resolution.
Figure 18B:
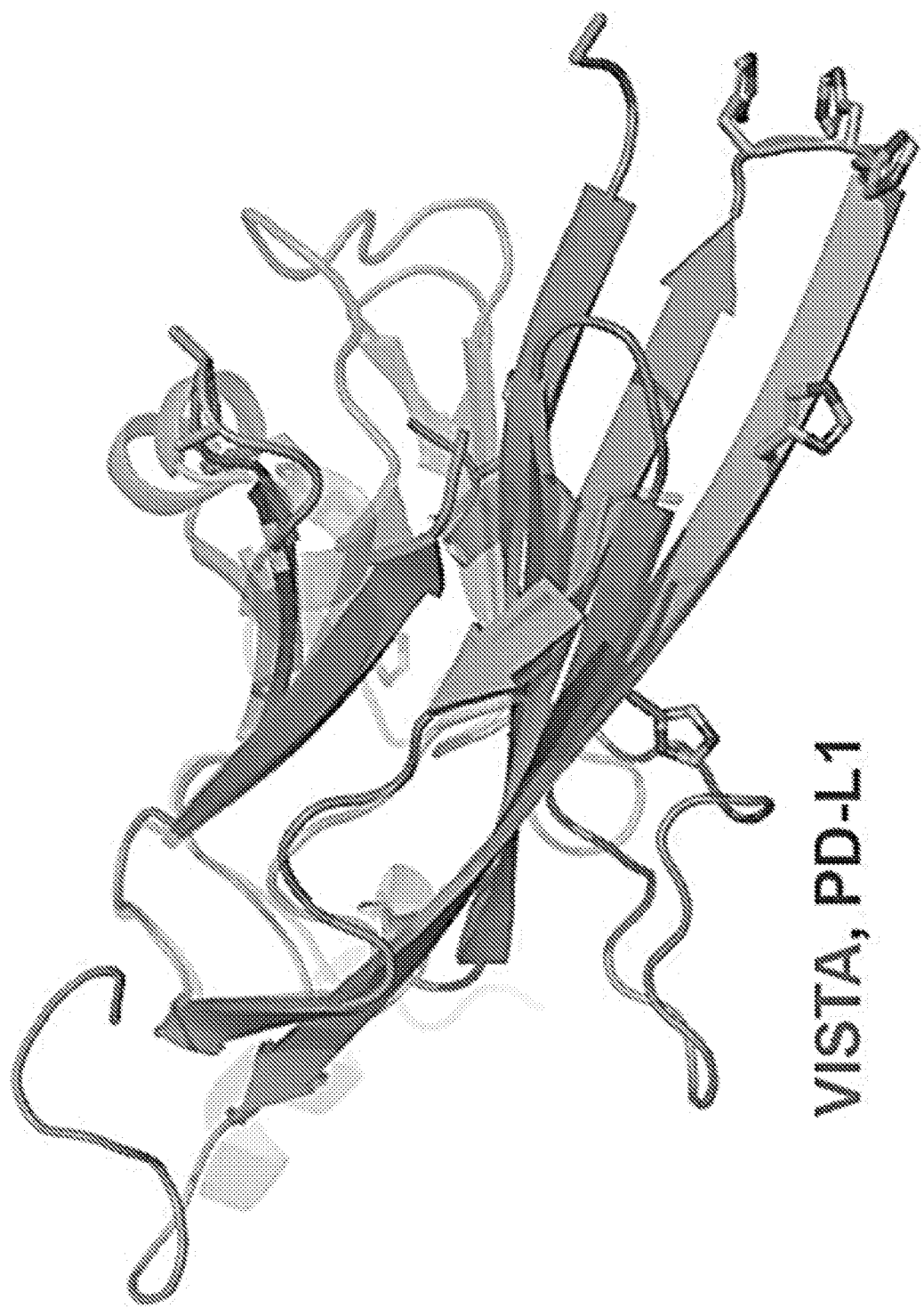
Figure 18C:
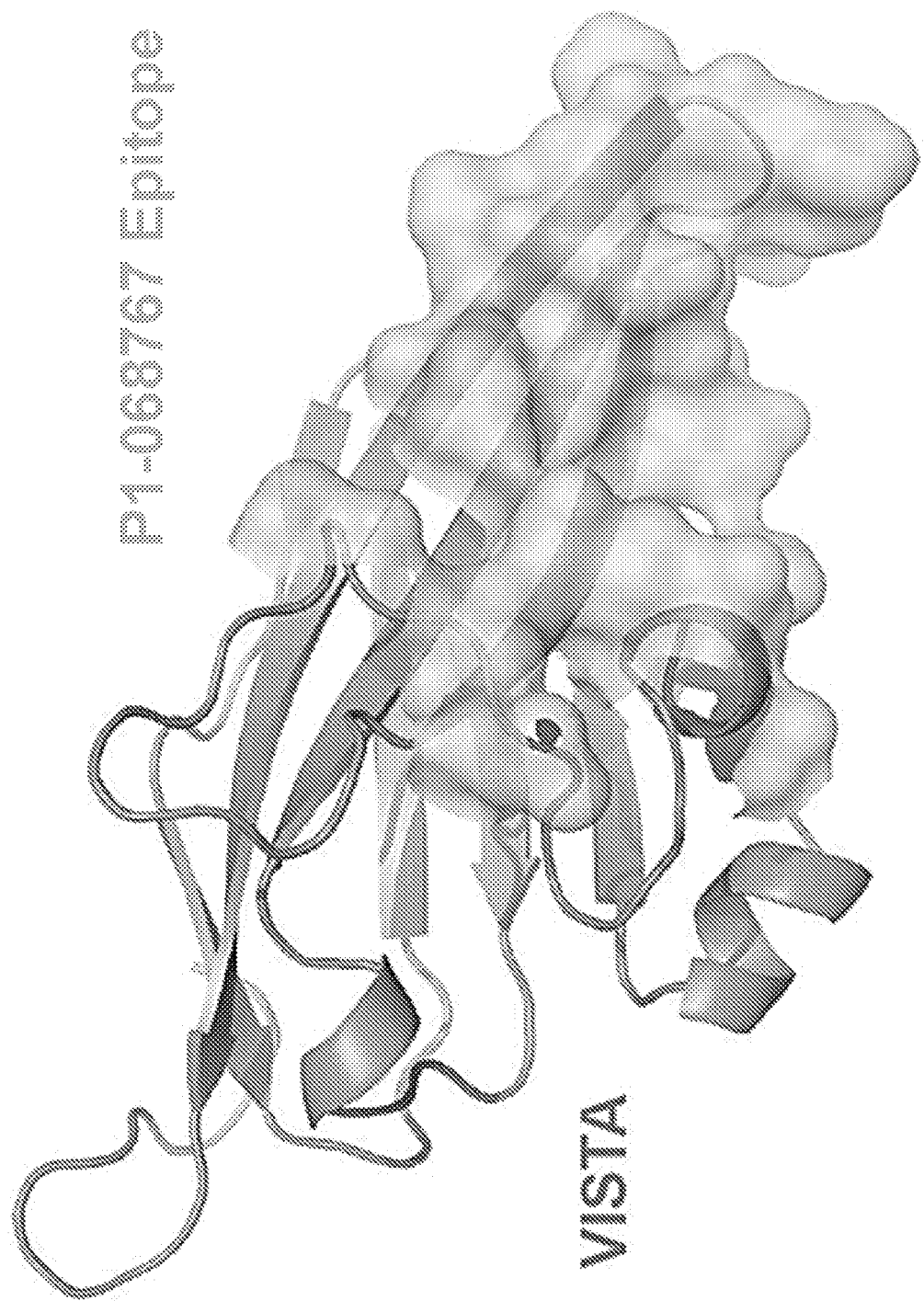
Figure 18D:
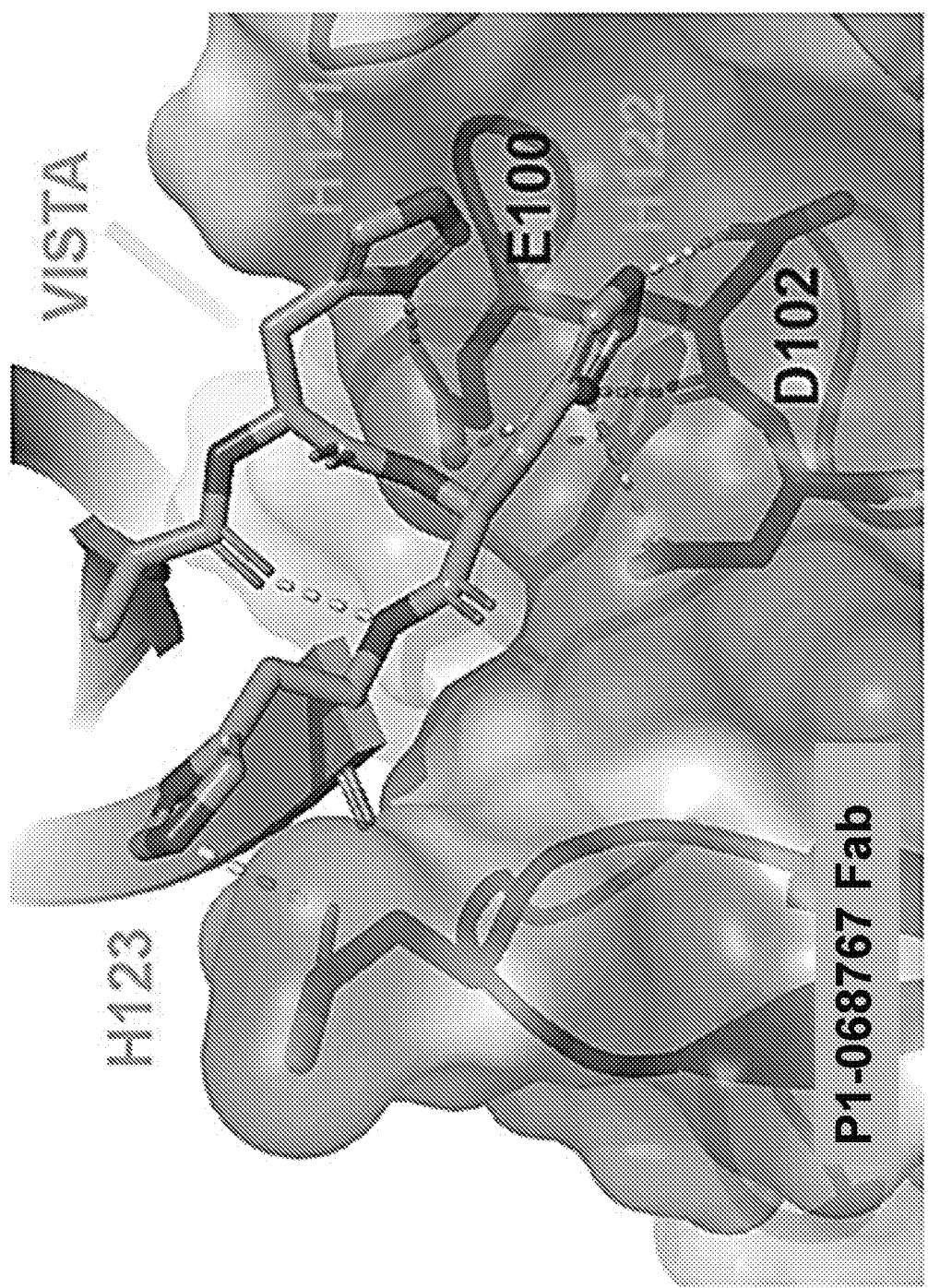
Figure 18E:
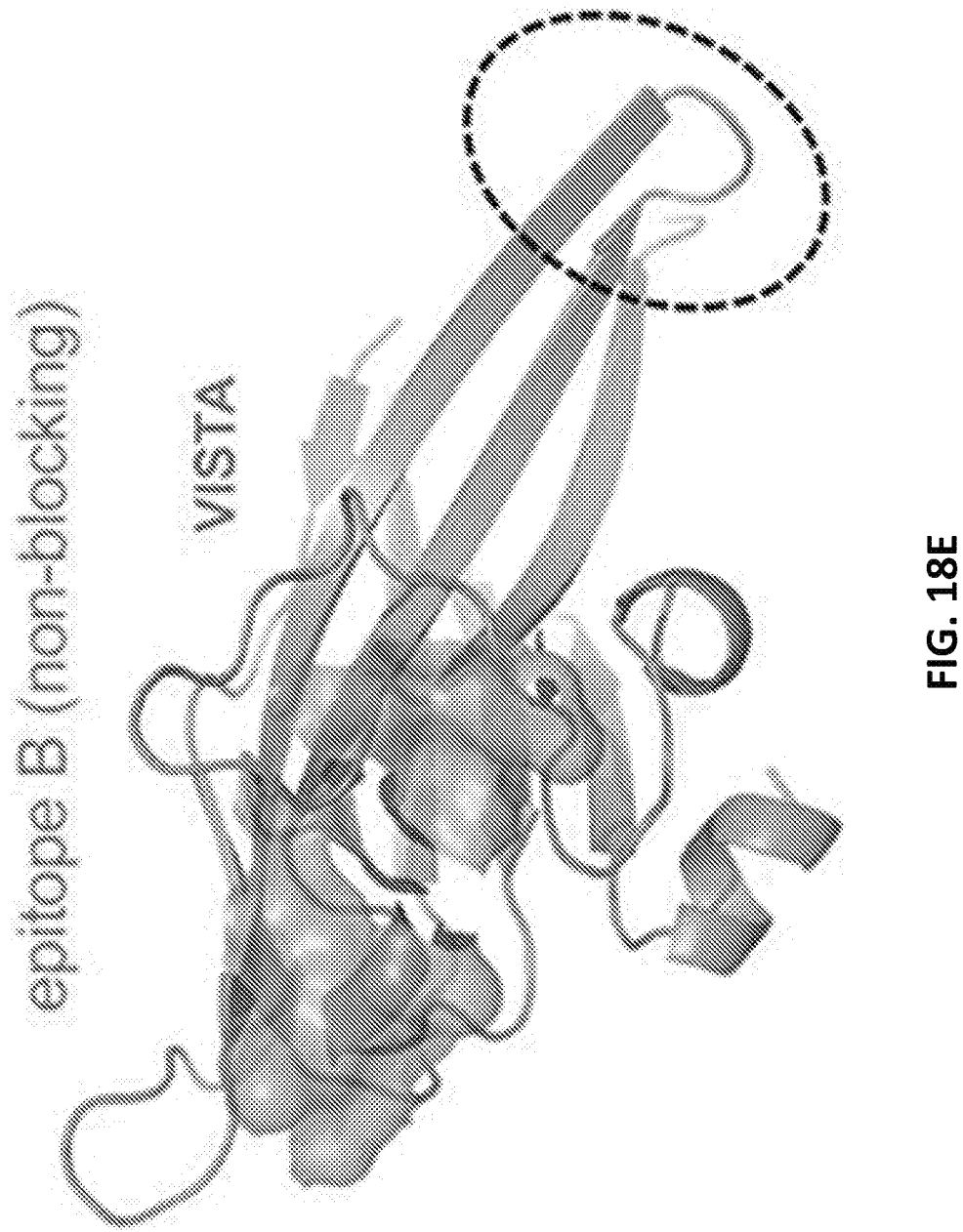

To characterize VISTA's structure and the molecular determinants of VISTA antibody binding, a co-crystal of the hVISTA IgV domain with the P1-068767 Fragment antigen-binding (Fab) was made. The structure of the resulting complex was determined at 1.6 Å resolution (FIG. 18). The VISTA IgV domain is generally characteristic of its family, with some resemblance to PD-L1 (FIG. 18B). However, unlike PD-L1 and most other B7 family or immunoglobulin superfamily members, the VISTA IgV domain's two C-terminal β-strands contain multiple additional residues, resulting in an unusually elongated and histidine-rich central β-sheet (FIG. 18B). P1-068767, a blocking antibody, binds VISTA at this β-sheet extension (FIG. 18C), while the non-blocking antibody VISTA.5 binds a different region (FIG. 18E). VISTA's β-sheet extension is capped by three histidine residues: H121, H122, and H123. P1-068767 residues E 10 and D 112 form hydrogen bonds with VISTA residues H121 and H122 respectively (FIG. 18D). These interactions fit well with the findings described in previous Examples that P1-068767 residues E110 and D112 are necessary and sufficient for acidic pH-selectivity. In the cocrystal, VISTA residue H123 interacts with a sulfate molecule from the precipitant and forms a salt bridge with P1-068767 residue E1; though it is possible that VISTA H123 can form a bona fide hydrogen bond with P1-068767 in the absence of sulfate (FIG. 18D). Additional interactions are provided in Table 24. These data suggest that the VISTA IgV domain's unusual, histidine-rich β-sheet extension is a key component of VISTA's acidic pH-selective receptor-ligand interface.

Table 24 details the distances in Ångströms (Å), between '767 Fab HC atoms within 4 Å of VISTA atoms.

| ## | '767 Fab HC | | | Dist. | VISTA | | |
|---|---|---|---|---|---|---|---|
| 1 | H: GLU | 1 | [OE1] | 3.1 | V: HIS | 123 | [NE2] |
| 2 | H: VAL | 2 | [N] | 3.2 | V: HIS | 123 | [O] |
| 3 | H: GLY | 26 | [O] | 3.1 | V: GLU | 125 | [N] |

VISTA with the antibodies described above P1-061015, P1-061029, P1-068761, and P1-068767, and thus belongs to the same epitope group as these antibodies (Group A). VISTA.4 does not compete for binding to human VISTA with VISTA mAb 1 (see FIG. 11A).

The epitope of VISTA.4 was also mapped using yeast surface display and NGS, as described in Example 15 for antibodies P1-061015, P1-061029, P1-068761, and P1-068767. VISTA mutants that lost binding to the antibody being mapped but retained binding to a non-blocking antibody (mAb1) were sorted and sequenced. Since they retained binding to mAb1, these mutants were likely correctly folded, and the loss of binding seen to the antibody being mapped was likely due to the loss of an energetically important contact residue. The positions of the mutations that resulted in loss of binding, and which were designated as energetically important residues in the antibody's epitope, and are shown in Table 31, along with the energetically important contact residues of antibodies P1-061015, P1-061029, P1-068761, and P1-068767 (also shown in Table 14 above).

TABLE 31

Energetically important contact residues of antibodies VISTA.4, '029, '015, '761, and '767

| mAb | V 34 | T 35 | Y 37 | K 38 | T 39 | Y 41 | S 52 | R 54 | F 61 | Q 62 | L 63 | L 65 | H 66 | L 67 | H 68 | H 69 | F 97 |
|---|---|---|---|---|---|---|---|---|---|---|---|---|---|---|---|---|---|
| VISTA.4 | x | x | x |   | x | x | x | x |   | x |   | x | x |   | x |   |   |
| '015 |   |   |   | x | x | x |   | x |   |   | x | x | x | x |   |   | x |
| '029 |   |   | x |   | x | x |   | x | x | x | x | x |   |   | x | x |   |
| '761 |   | x | x |   |   | x |   | x | x | x |   |   | x | x | x | x |   |
| '767 |   |   | x |   | x | x |   | x | x | x | x | x |   |   |   |   |   |

| mAb | L 115 | V 117 | E 118 | I 119 | R 120 | H 121 | H 122 | S 124 | E 125 | R 127 |
|---|---|---|---|---|---|---|---|---|---|---|
| VISTA.4 | x | x |   | x | x | x | x | x | x |   |
| '015 | x | x |   | x |   |   |   | x | x |   |
| '029 | x | x |   | x |   |   |   | x | x | x |
| '761 | x | x |   | x |   |   |   | x | x | x |
| '767 | x | x |   | x |   | x | x | x | x | x |

-continued

| ## | '767 Fab HC | | | Dist. | VISTA | | |
|---|---|---|---|---|---|---|---|
| 4 | H: GLU | 30 | [O] | 3.3 | V: ARG | 54 | [NH2] |
| 5 | H: GLU | 30 | [OE1] | 3.8 | V: ARG | 127 | [NE] |
| 6 | H: GLU | 30 | [OE1] | 3.2 | V: ARG | 127 | [NH2] |
| 7 | H: GLU | 30 | [OE2] | 3.4 | V: ARG | 127 | [NH1] |
| 8 | H: GLU | 30 | [OE2] | 3.5 | V: ARG | 127 | [NH2] |
| 9 | H: ASP | 31 | [OD1] | 2.8 | V: ARG | 54 | [NH1] |
| 10 | H: ASP | 31 | [OD1] | 2.7 | V: ARG | 54 | [NH2] |
| 11 | H: ASP | 31 | [OD1] | 2.8 | V: ARG | 127 | [NH1] |
| 12 | H: ASP | 31 | [OD2] | 3.8 | V: ARG | 127 | [NE] |
| 13 | H: ASP | 31 | [OD2] | 3.1 | V: ARG | 127 | [NH1] |
| 14 | H: TYR | 32 | [OH] | 2.6 | V: GLU | 125 | [OE1] |
| 15 | H: GLU | 110 | [OE2] | 2.8 | V: HIS | 122 | [N] |
| 16 | H: GLU | 110 | [OE1] | 2.7 | V: HIS | 121 | [ND1] |
| 17 | H: GLU | 110 | [OE2] | 3.8 | V: HIS | 121 | [ND1] |
| 18 | H: GLU | 110 | [OE2] | 3.5 | V: HIS | 122 | [ND1] |
| 19 | H: ASP | 111 | [OD1] | 3.6 | V: HIS | 122 | [NE2] |
| 20 | H: ASP | 112 | [OD1] | 3.5 | V: HIS | 122 | [ND1] |

Example 21: Epitope Mapping of VISTA.4

VISTA.4 was used in the competitive BLI epitope binning assay previously described in Example 15. The results indicate that VISTA.4 competes for binding to human Hydrogen/deuterium exchange mass spectrometry (HDX-MS) was utilized to probe binding epitopes of human VISTA with mAb VISTA.4. HDX-MS probes protein conformation and conformational dynamics in solution by monitoring the rate and extent of deuterium exchange of backbone amide hydrogen atoms (Huang and Chen (2014) Analytical and Bioanalytical Chemistry 406, 6541-6558; Wei, et al. Drug Discovery Today (2014) 19, 95-102). The level of HDX depends on the solvent accessibility of backbone amide hydrogen atoms and the protein hydrogen bonds. The mass increase of the protein upon HDX can be precisely measured by MS. When this technique is paired with enzymatic digestion, structure features at the peptide level can be resolved, enabling differentiation of surface exposed peptides from those folded inside, or from those sequestered at the interface of a protein-protein complex. Typically, the deuterium labeling and subsequent quenching experiments are performed, followed by enzymatic digestion, peptide separation, and MS analysis.

Prior to epitope mapping experiments, non-deuteriated experiments were carried out to generate a list of common peptides for recombinant human VISTA (15 μM) and protein complexes of VISTA with mAb VISTA.4 (1:1 molar ratio). In the HDX-MS experiment, 5 μL of each sample (VISTA or VISTA with mAb VISTA.4) was diluted into 55 µL of D20 buffer (10 mM phosphate buffer, D20, pH7.0) to start the labeling reactions. The reactions were carried out for different periods of time: 1 min, 10 min and 240 min. By the end of each labeling reaction period, the reaction was quenched by adding quenching buffer (100 mM phosphate buffer with 4M GdnCl and 0.4M TCEP, pH 2.5, 1:1, v/v) and 50 µL of quenched sample was injected into Waters HDX-MS system for analysis. The deuterium uptake levels of common peptic peptides were monitored in the absence/presence of VISTA.4. The obtained sequence coverage was 82%.

Figures 19, 20:
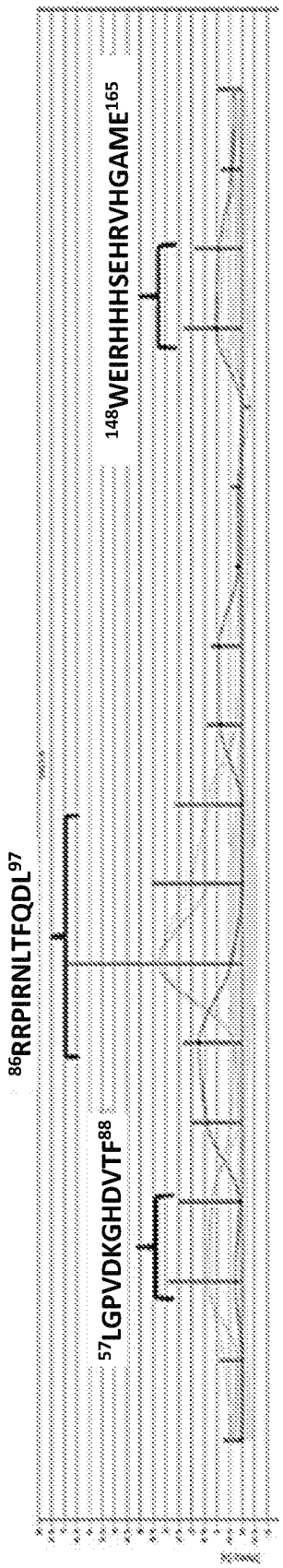
FIG. 19 shows the epitope of VISTA.4 as determined by MS-HDX (MS trace).
FIG. 20 shows the location of the epitope of VISTA.4 in the amino acid sequence of hVISTA based on the data in FIG. 19. Residues 57-68, 86-97, and 148-165, also highlighted in FIG. 19, are depicted in lighter grey text and underlining in FIG. 20.

HDX-MS experiments provided 85% sequence coverage for human VISTA. As shown in FIG. 19, the HDX-MS data analysis on VISTA.4 in human VISTA indicates that VISTA.4's epitope is comprised of three regions of human VISTA, with region 2 being the primary epitope (residue numbers correspond to native human VISTA sequence, FIG. 20):

```
Region 1:
57LGPVDKGHDVTF68

Region 2:
86RRPIRNLTFQDL97

Region 3:
148VVEIRHEIHSEHRVHGAME165
```

Antibody VISTA.4 bound equally well at acidic and neutral pH. Further rounds of selection yielded a variant that bound VISTA with 200-fold higher affinity at pH 6.0 than at pH 7.4. Similar efforts with VISTA blocking antibodies produced variants with up to 10,000-fold selectivity for pH 6.0 relative to pH 7.4. We used these antibodies to map VISTA's receptor-ligand binding interface at acidic and neutral pH. pH-independent, neutral pH-selective, and acidic pH-selective VISTA blocking antibodies bound nearly identical epitopes, suggesting that histidine protonation alone, without marked conformational changes, controls VISTA's ability to engage its counter-receptor at acidic pH. (VISTA.4 is further described in another application family by the same applicants.)

Example 22: VISTA.4 Inhibits VISTA Binding to T Cells at Acidic pH

Figure 21B:
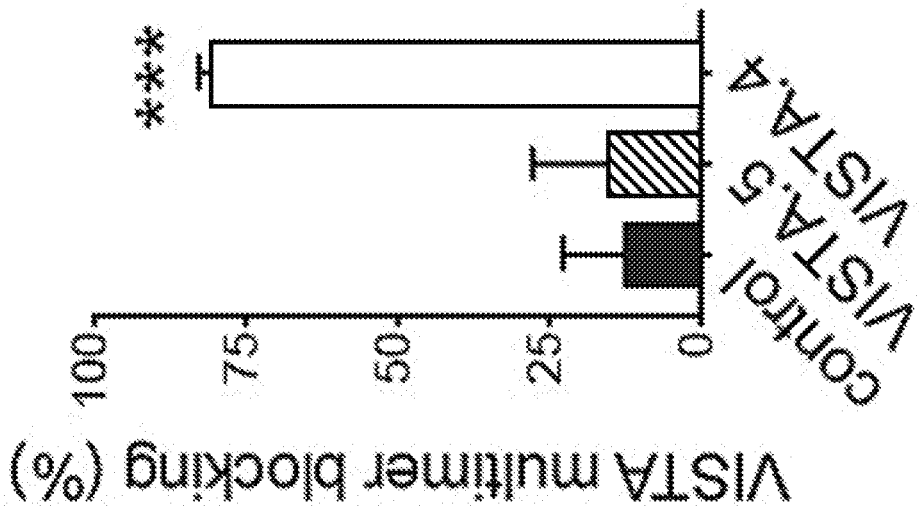
FIGS. 21A and 21B show VISTA multimer binding to activated human CD4+ T cells at pH 6.0 in the presence of the antibodies VISTA.4 (triangles), VISTA.5 (squares), and a non-VISTA-binding (control, circles).
Figure 21A:
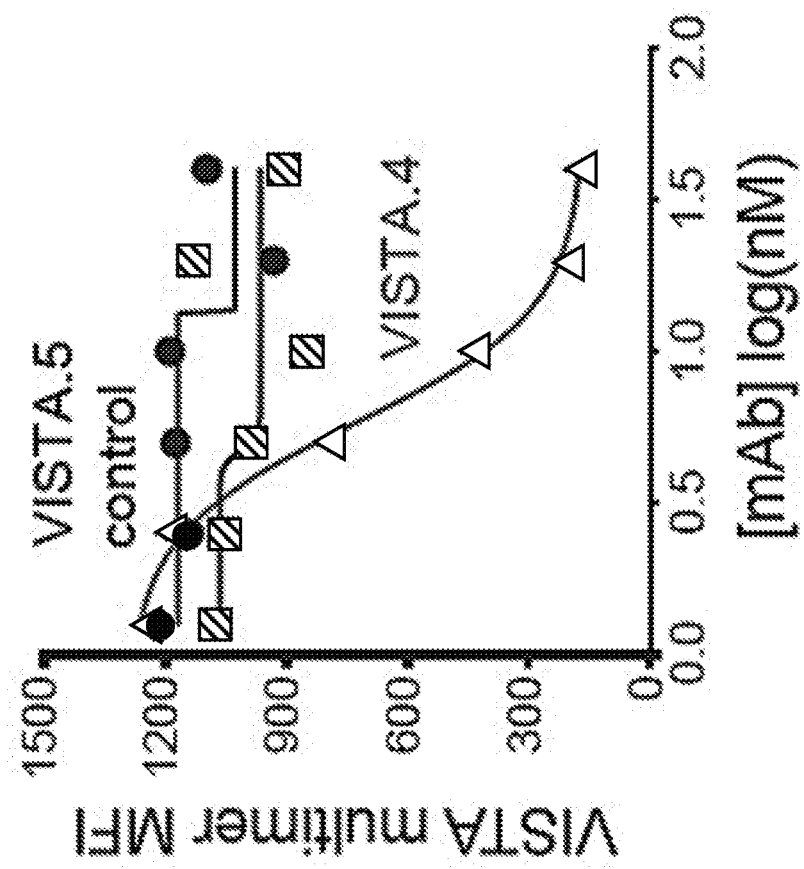

This Example shows that VISTA.4 and other antibodies in epitope group A blocked VISTA binding to T cells at acidic pH, whereas VISTA.5 (mAb1) and other antibodies in epitope group B did not (FIGS. 21A and B).

This example was conducted essentially as described in Example 4.

Example 23: VISTA.4 Enhances T Cell Proliferation and IFN-γ Production

Figure 22B:
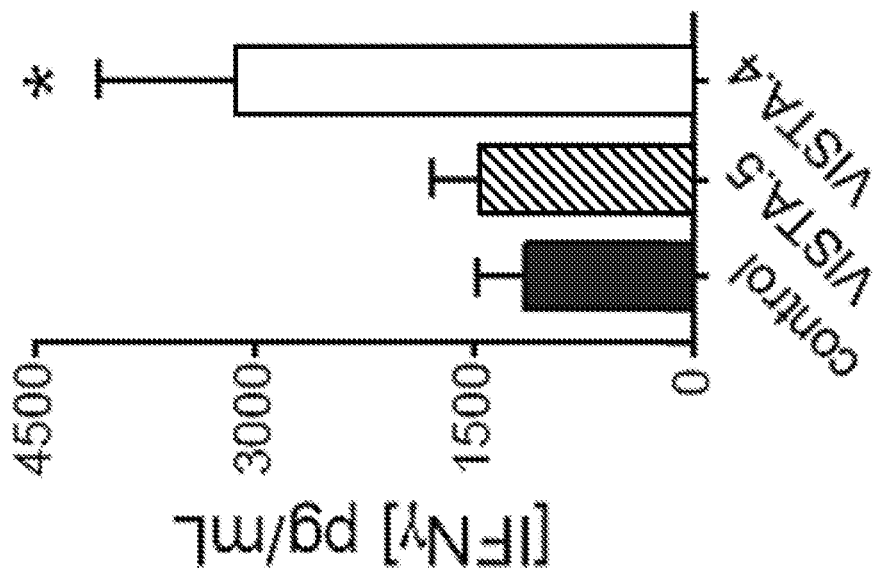
FIG. 22 shows that antibodies that block VISTA binding at acidic pH are functional. Effects of the blocking antibody VISTA.4 (squares), the non-blocking antibody VISTA.5 (triangles), and a non-VISTA-binding (control, circles) antibody on the proliferation (FIG. 22A) and interferon gamma production (FIG. 22B) of human CD4+ T cells co-cultured with 293T cells engineered to express VISTA and a TCR agonist (293T-OKT3-VISTA). One-way ANOVA with Dunnett's multiple comparisons, *, $P<0.05$. These data are representative of more than four independent experiments.
Figure 22A:
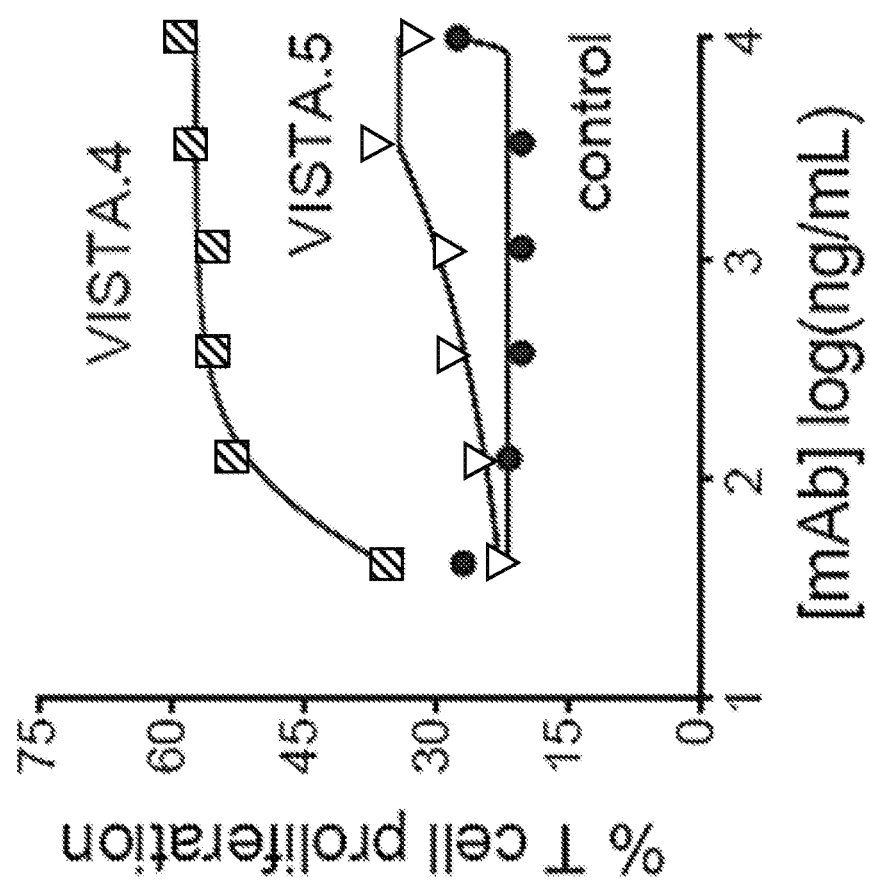

This Example shows that VISTA blocking Abs (epitope Group A) enhanced T cell proliferation and IFN-γ production (FIG. 22). VISTA.5 (mAb1), which is not a blocking antibody, did not enhance T cell proliferation or IFN-γ production. VISTA.4 had no effect when T cells were co-cultured with 293T-OKT3 cells that did not express VISTA.

This experiment was conducted by adding VISTA antibodies to CD4+ T cells co-cultured with 293T cells engineered to express human VISTA and a single chain variable fragment of the T cell receptor agonist antibody OKT3 (293T-OKT3-VISTA).

Example 24: VISTA Suppressed T Cell Receptor-Mediated NF-kB Signaling

Figure 23:
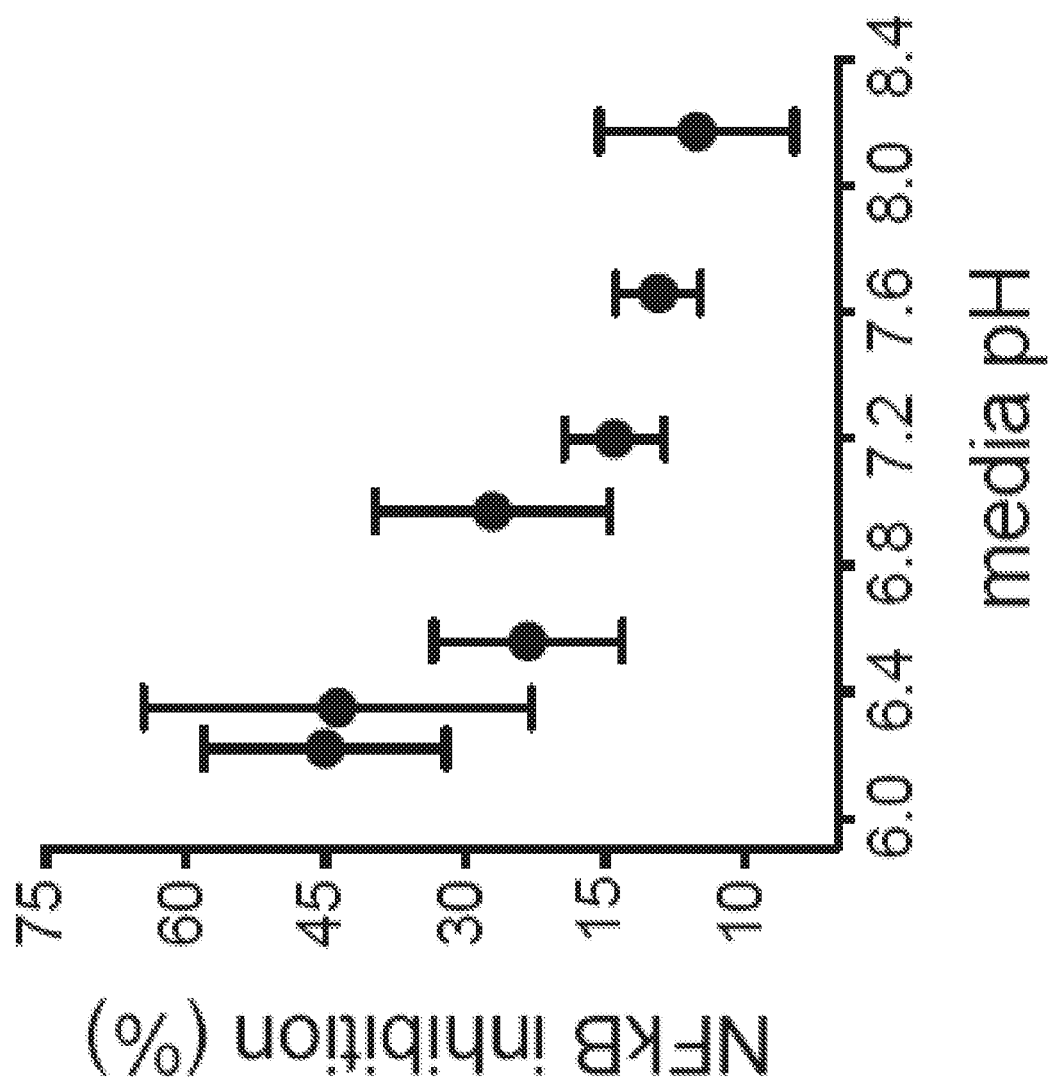
FIG. 23 shows the effects of VISTA.4 blockade on Jurkat T cell activation (by measurement of NF-kB inhibition) following co-culture with 293T-OKT3-VISTA cells at different pH. These data are representative of a composite of three independent experiments.
Figure 24:
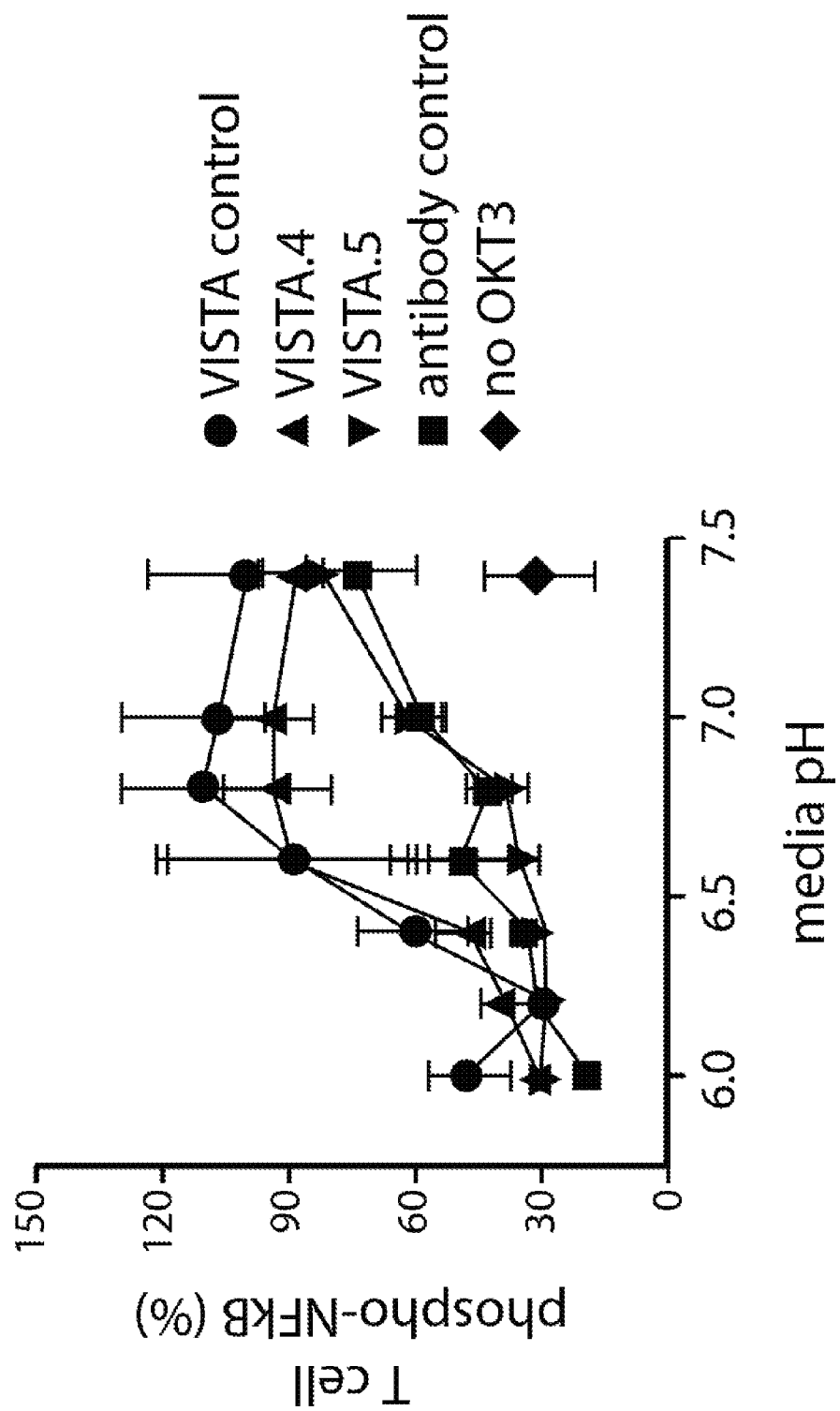
FIG. 24 shows effects of pH on VISTA suppression of human CD4+ T cells. Cells were stimulated at the indicated pH with plate coated OKT3 and VISTA-Fc in the presence of VISTA.4 (upward triangles), VISTA.5 (downward triangles), or a non-VISTA-binding antibody (antibody control, squares). Cells stimulated with plate-coated OKT3 and control IgG (VISTA control, black circles) or without OKT3 (no OKT3, grey diamond) are also shown. These data are representative of one independent experiment.

This Example was conducted to further assess the effects of pH on VISTA function, and shows that VISTA suppressed T cell receptor-mediated NF-kB signaling more potently at acidic pH than at neutral pH (FIG. 23A). Maximal suppression was reached below pH 6.5, similar to VISTA: T cell binding (FIG. 23A and FIG. 4A).

NF-kB signaling was measured using NFkB-reporting Jurkat T cells, essentially as described in Examples 5 and 13. Jurkat cells were engineered to express luciferase under the control of an NF-kB-inducible promoter. These Jurkat NFkB-luciferase cells were co-cultured with non-irradiated 293T-OKT3-VISTA cells at a ratio of 4:1 in HBSS (ThermoFisher) acidified to various pH with MES and human anti-human VISTA antibodies for 4 hours. Jurkat cell activation was measured by luciferase substrate assay (Promega). VISTA-mediated suppression was most potent at acidic pH, though a modest level of activity was maintained at pH 7.0 and above. Similarly, recombinant VISTA suppressed T cell NFkB phosphorylation at acidic pH more so than at pH 7.4 (FIG. 23B). These results indicate that VISTA suppresses T cells preferentially at acidic pH, and that this activity is reversed by antibodies that block T cell binding at acidic pH.

Thus, these data suggest that blockade of VISTA's acidic pH-selective receptor-ligand interface could reverse immunosuppression.

Figure 25B:
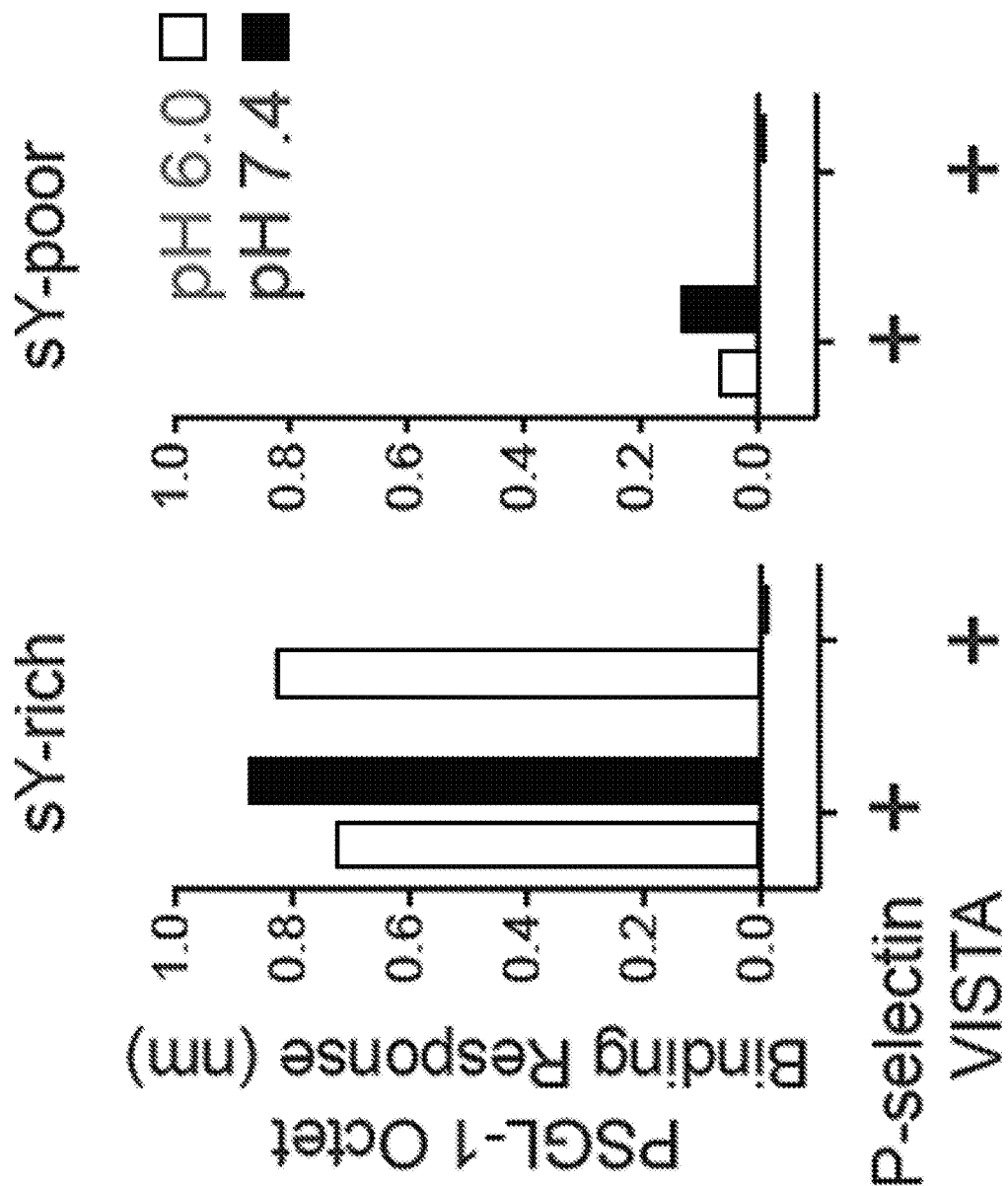
As shown in FIG. 25B, human PSGL-1 19-mer-Fc glycopeptides produced with sialyl lewis X decoration were separated into fractions with greater than 90% tyrosine sulfation (sY-rich) and less than 1% tyrosine sulfation (sY-poor). BLI binding magnitudes at pH 6.0 (white) and 7.4 (black) are shown for VISTA-Fc and P-selectin-Fc as indicated. These data are representative of a single independent experiment. As provided in FIGS. 25C-25D, human VISTA-Fc recombinant proteins were produced with the histidine residues at positions 153-155 left intact (WT VISTA) or replaced by alanine (H2A mutant), aspartic acid (H2D mutant), or arginine (H2R mutant).

Example 25: VISTA: PSGL-1 Binding Specificity is Determined by Histidine and Sulfotyrosine Residues To characterize PSGL-1 binding specificity, in addition to that provided by sialyl lewis X (described in Example 19), we examined tyrosine sulfation post-translational modifications that contribute to P-selectin binding. To test the role of tyrosine sulfation, PSGL-1 glycopeptides were fractioned into sulfotyrosine-rich (>90%) and sulfotyrosine-poor (<1%) peaks by anion exchange liquid chromatography. Neither VISTA nor P-selectin bound detectably to sulfotyrosine-poor PSGL-1 (FIG. 25B). VISTA was also unable to bind PSGL-1 glycopeptides in which tyrosines were substituted with alanines (not shown in figures). These results indicate that sulfotyrosine residues are key mediators of PSGL-1 binding to VISTA.

Figure 25C:
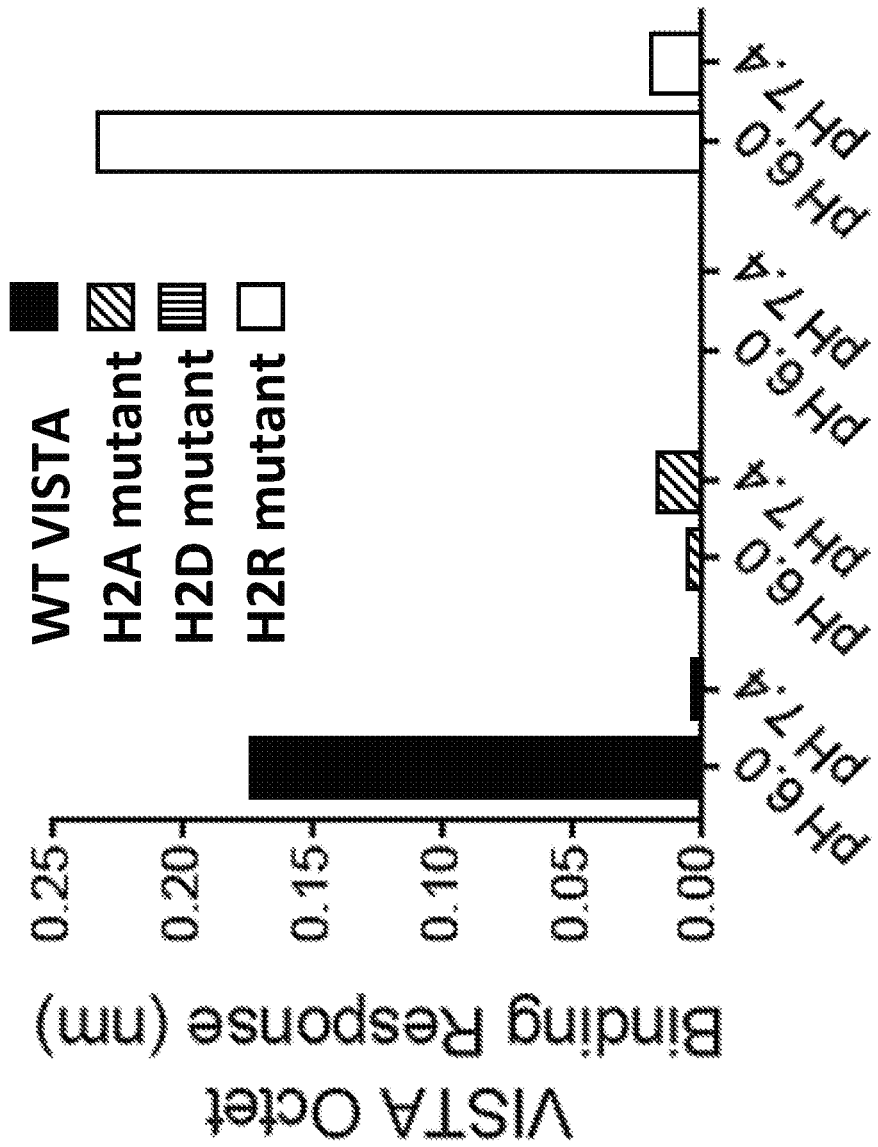
FIG. 25C shows BLI binding magnitudes for wildtype and mutant VISTA-Fc proteins binding to captured PSGL-1 at pH 6.0 and 7.4. These data are representative of a single experiment.
Figure 25D:
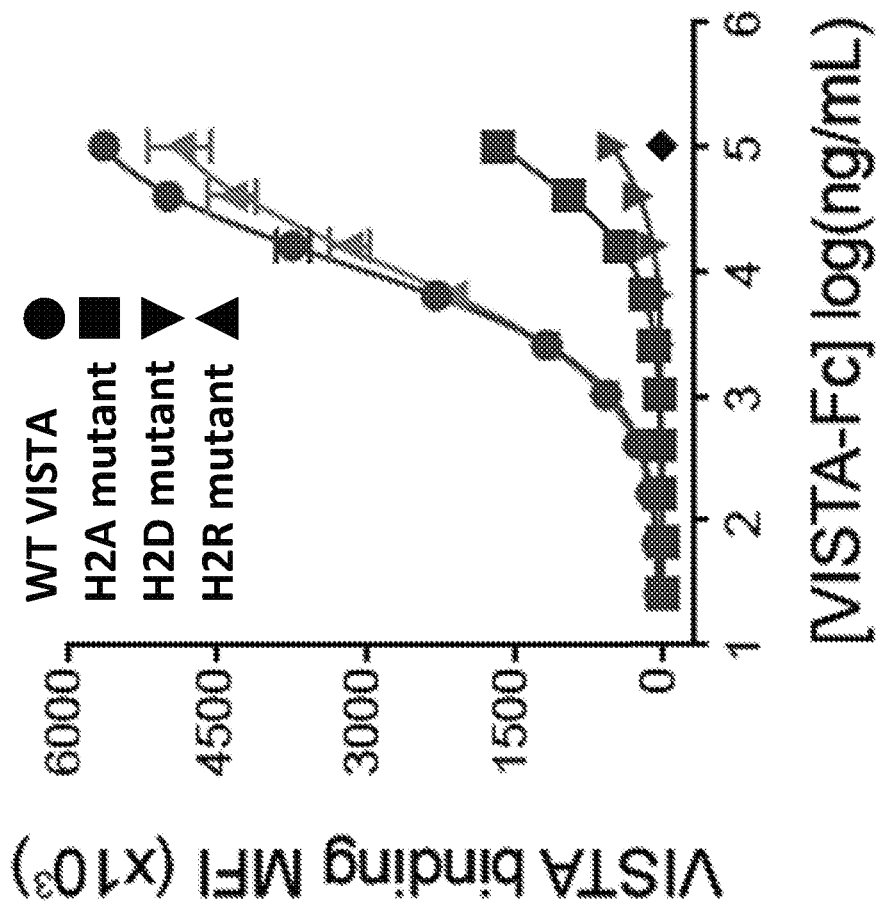
FIG. 25D shows VISTA-Fc binding to CHO-PSGL-1 cells at pH 6.0 of WT VISTA (circles), H2A mutant (squares), H2D mutant (downward triangles), and H2R mutant (grey upward triangles), as well as a control (diamonds). These data are representative of two independent experiments.

We hypothesized that VISTA binding specificity is mediated by the same histidine residues found within the VISTA blocking antibody epitope: H153, H154, and H155 (see Example 20). Replacement of these histidine residues with noncharged alanine or negatively charged aspartic acid significantly reduced VISTA binding to recombinant PSGL-1 and CHO-PSGL-1 cells (FIGS. 25C-D). VISTA-Fc proteins with H153, H154, and H155 residues mutated to alanine, aspartic acid, or arginine were produced by transient transfection of Expi293 cells. These mutants were also unable to functionally suppress T cells (not shown in figures). In contrast, replacement with positively charged arginine residues preserved VISTA binding and function (FIG. 25C-D). The blocking antibodies VISTA.4 and P1-068767 bound well to alanine and arginine mutant VISTA, but poorly to aspartic acid mutant VISTA (not shown). The non-blocking antibody VISTA.5 bound comparably to wild-type and mutant VISTA proteins (not shown).

Figure 25E:
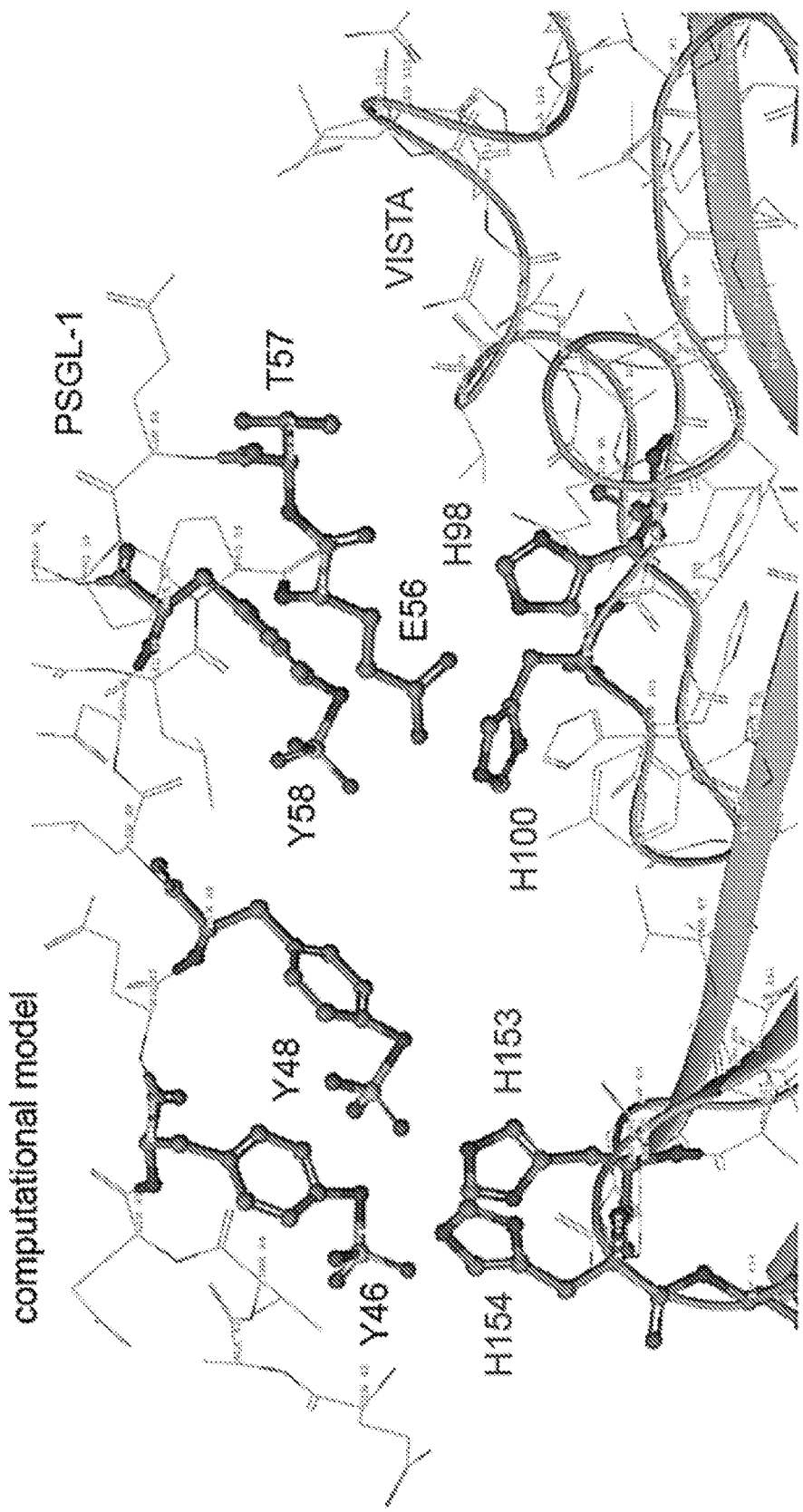
FIG. 25E shows a computational model of the PSGL-1 19-mer glycopeptide (top) in complex with VISTA's histidine-rich ligand interface (grey ribbons, bottom). VISTA residues H98, I-1100, H153, and H154 are marked. PSGL-1 residues Y46, Y48, E56, T57, and Y58 are also marked.

We then used the solved structures of PSGL-1 bound to P-selectin and VISTA bound to P1-068767 Fab (FIG. 18) to develop a computational model of the PSGL-1 19-mer glycopeptide docked to VISTA (FIG. 25E). In this model, PSGL-1 tyrosine residues Y46 and Y48 make ionic interactions with VISTA histidine residues H153 and H154 (2.5-3.0 Å distances). PSGL-1 Y51 is more distant from VISTA (~4.5 Å), but may interact meaningfully with VISTA H100. PSGL-1 E56 also forms ionic interactions with VISTA H98 and H100. The hydroxyl group of PSGL-1 T57, which can be decorated with sialyl lewis X, points away from VISTA, consistent with the negligible influence of sialyl lewis X on VISTA: PSGL-1 binding. Taken together, these data and modeling suggest that VISTA binding to PSGL-1 at acidic pH is driven primarily by the VISTA histidine residues and H153, H154, and H155, and by the PSGL-1 sulfated tyrosine residues Y46 and Y48.

Sequence Table

The following is a table of certain sequences referred to in this application. In SEQ ID NO: 2, amino acid position 187 may be either a D or an E.

In the antibody sequences below, the VH CDR1, CDR2, and CDR3 sequences are located at amino acid positions comprising amino acids 26-35, 50-66, and 99-110, respectively, and the VL CDR1, CDR2, and CDR3 sequences are located at amino acid positions comprising amino acids 24-35, 51-57, and 90-98, respectively. The VH CDR1 is numbered according to AbM (AA 26-35; Abhinandan and Martin (2008) Mol. Immunol. 45:3832-3839; Swindells et al. (2017) J. Mol. Biol. 429:356-364) and all other CDRs (VH-CDR2, VH CDR3, VL CDR1-3) are numbered according to Kabat. The CDR sequences of particular antibody species are bold and underlined below on their VH and VL sequences.

| SEQ ID NO | Name | Sequence |
|---|---|---|
| 1 | hVISTA (with leader sequence) | MGVPTALEAG SWRWGSLLFA LFLAASLGPV AAFKVATPYS LYVCPEGQNV TLTCRLLGPV DKGHDVTFYK TWYRSSRGEV QTCSERRPIR NLTFQDLHLH HGGHQAANTS HDLAQRHGLE SASDHHGNFS ITMRNLTLLD SGLYCCLVVE IRHHHSEHRV HGAMELQVQT GKDAPSNCVV YPSSSQDSEN ITAAALATGA CIVGILCLPL ILLLVYKQRQ AASNRRAQEL VRMDSNIQGI ENPGFEASPP AQGIPEAKVR HPLSYVAQRQ PSESGRHLLS EPSTPLSPPG PGDVFFPSLD PVPDSPNFEV I |
| 2 | hVISTA (no leader sequence) | FKVATPYSLY VCPEGQNVTL TCRLLGPVDK GHDVTFYKTW YRSSRGEVQT CSERRPIRNL TFQDLHLHHG GHQAANTSHD LAQRHGLESA SDHHGNFSIT MRNLTLLDSG LYCCLVVEIR HHHSEHRVHG AMELQVQTGK DAPSNCVVYP SSSQ[D/E]SENIT AAALATGACI VGILCLPLIL LLVYKQRQAA SNRRAQELVR MDSNIQGIEN PGFEASPPAQ GIPEAKVRHP LSYVAQRQPS ESGRHLLSEP STPLSPPGPG DVFFPSLDPV PDSPNFEVI |
| 3 | Human PSGL-1 isoform 2 precursor, with signal peptide | MPLQLLLLLI LLGPGNSLQL WDTWADEAEK ALGPLLARDR RQATEYEYLD YDFLPETEPP EMLRNSTDTT PLTGPGTPES TTVEPAARRS TGLDAGGAVT ELTTELANMG NLSTDSAAME IQTTQPAATE AQTTQPVPTE AQTTPLAATE AQTTRLTATE AQTTPLAATE AQTTPPAATE AQTTQPTGLE AQTTAPAAME AQTTAPAAME AQTTPPAAME AQTTQTTAME AQTTAPEATE AQTTQPTATE AQTTPLAAME ALSTEPSATE ALSMEPTTKR GLFIPFSVSS VTHKGIPMAA SNLSVNYPVG APDHISVKQC LLAILILALV ATIFFVCTVV LAVRLSRKGH MYPVRNYSPT EMVCISSLLP DGGEGPSATA NGGLSKAKSP GLTPEPREDR EGDDLTLHSF LP |
| 4 | Human PSGL-1 isoform 2, without signal, peptide | LQL WDTWADEAEK ALGPLLARDR RQATEYEYLD YDFLPETEPP EMLRNSTDTT PLTGPGTPES TTVEPAARRS TGLDAGGAVT ELTTELANMG NLSTDSAAME IQTTQPAATE AQTTQPVPTE AQTTPLAATE AQTTRLTATE AQTTPLAATE AQTTPPAATE AQTTQPTGLE AQTTAPAAME AQTTAPAAME AQTTPPAAME AQTTQTTAME AQTTAPEATE AQTTQPTATE AQTTPLAAME ALSTEPSATE ALSMEPTTKR GLFIPFSVSS VTHKGIPMAA SNLSVNYPVG APDHISVKQC LLAILILALV ATIFFVCTVV LAVRLSRKGH MYPVRNYSPT EMVCISSLLP DGGEGPSATA NGGLSKAKSP GLTPEPREDR EGDDLTLHSF LP |
| 5 | Human PSGL-1 isoform 2 ECD, with signal peptide | MPLQLLLLLI LLGPGNSLQL WDTWADEAEK ALGPLLARDR RQATEYEYLD YDFLPETEPP EMLRNSTDTT PLTGPGTPES TTVEPAARRS TGLDAGGAVT ELTTELANMG NLSTDSAAME IQTTQPAATE AQTTQPVPTE AQTTPLAATE AQTTRLTATE AQTTPLAATE AQTTPPAATE AQTTQPTGLE AQTTAPAAME AQTTAPAAME AQTTPPAAME AQTTQT |

| SEQ ID NO | Name | Sequence |
|---|---|---|
| 6 | Human PSGL-1 isoform 2 ECD, without signal peptide | LQL WDTWADEAEK ALGPLLARDR RQATEYEYLD YDFLPETEPP EMLRNSTDTT PLTGPGTPES TTVEPAARRS TGLDAGGAVT ELTTELANMG NLSTDSAAME IQTTQPAATE AQTTQPVPTE AQTTPLAATE AQTTRLTATE AQTTPLAATE AQTTPPAATE AQTTQPTGLE AQTTAPAAME AQTTAPAAME AQTTPPAAME AQTTQT |
| 7 | Human PSGL-1 ECD (N-terminal positions 42 to 295 of a full length Human PSGL-1 Accession No. AAC50061) | QATEYEYLD YDFLPETEPP EMLRNSTDTT PLTGPGTPES TTVEPAARRS TGLDAGGAVT ELTTELANMG NLSTDSAAME IQTTQPAATE AQTTPLAATE AQTTRLTATE AQTTPLAATE AQTTPPAATE AQTTQPTGLE AQTTAPAAME AQTTAPAAME AQTTPPAAME AQTTQTTAME AQTTAPEATE AQTTQPTATE AQTTPLAAME ALSTEPSATE ALSMEPTTKR GLFIPFSVSS VTHKGIPMAA SNLSV |
| 8 | HumPSGL-1 isoform 1 precursor, with signal peptide NP_001193538 | MAVGASGLEG DKMAGAMPLQ LLLLLILLGP GNSLQLWDTW ADEAEKALGP LLARDRRQAT EYEYLDYDFL PETEPPEMLR NSTDTTPLTG PGTPESTTVE PAARRSTGLD AGGAVTELTT ELANMGNLST DSAAMEIQTT QPAATEAQTT QPVPTEAQTT PLAATEAQTT RLTATEAQTT PLAATEAQTT PPAATEAQTT QPTGLEAQTT APAAMEAQTT APAAMEAQTT PPAAMEAQTT QTTAMEAQTT APEATEAQTT QPTATEAQTT PLAAMEALST EPSATEALSM EPTTKRGLFI PFSVSSVTHK GIPMAASNLS VNYPVGAPDH ISVKQCLLAI LILALVATIF FVCTVVLAVR LSRKGHMYPV RNYSPTEMVC ISSLLPDGGE GPSATANGGL SKAKSPGLTP EPREDREGDD LTLHSFLP |
| 9 | Human PSGL-1, without signal peptide | LQLWDTW ADEAEKALGP LLARDRRQAT EYEYLDYDFL PETEPPEMLR NSTDTTPLTG PGTPESTTVE PAARRSTGLD AGGAVTELTT ELANMGNLST DSAAMEIQTT QPAATEAQTT QPVPTEAQTT PLAATEAQTT RLTATEAQTT PLAATEAQTT PPAATEAQTT QPTGLEAQTT APAAMEAQTT APAAMEAQTT PPAAMEAQTT QTTAMEAQTT APEATEAQTT QPTATEAQTT PLAAMEALST EPSATEALSM EPTTKRGLFI PFSVSSVTHK GIPMAASNLS VNYPVGAPDH ISVKQCLLAI LILALVATIF FVCTVVLAVR LSRKGHMYPV RNYSPTEMVC ISSLLPDGGE GPSATANGGL SKAKSPGLTP EPREDREGDD LTLHSFLP |
| 10 | Human PSGL-1 ECD, with signal peptide | MAVGASGLEG DKMAGAMPLQ LLLLLILLGP GNSLQLWDTW ADEAEKALGP LLARDRRQAT EYEYLDYDFL PETEPPEMLR NSTDTTPLTG PGTPESTTVE PAARRSTGLD AGGAVTELTT ELANMGNLST DSAAMEIQTT QPAATEAQTT QPVPTEAQTT PLAATEAQTT RLTATEAQTT PLAATEAQTT PPAATEAQTT QPTGLEAQTT APAAMEAQTT APAAMEAQTT PPAAMEAQTT QT |
| 11 | P1-069059 VH | EVQLVESGGGLVQPGKSLRLSCAASGFTLEDYAMHWVRQAPGKGLEW VSGINWNSDHIGYADSVKGRFTISRDNAKNSLYLQMNSLRTEDTALY YCAKVPGYSGGWIDAEDDWGQGTMVTVSS |
| 12 | P1-069059 VL | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 13 | P1-069059 IgG1.3 HC | EVQLVESGGGLVQPGKSLRLSCAASGFTLEDYAMHWVRQAPGKGLEW VSGINWNSDHIGYADSVKGRFTISRDNAKNSLYLQMNSLRTEDTALY YCAKVPGYSGGWIDAEDDWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 14 | P1-069059 LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 15 | P1-069061 VH | EVQLVESGGGLVQPGKSLRLSCAASGFTLEDYAMHWVRQAPGKGLEW VSGINWNSAEIGYADSVKGRFTISRDNAKNSLYLQMNSLRTEDTALY YCAKVPGYSGGWIDAEDDWGQGTMVTVSS |
| 16 | P1-069061 VL | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 17 | P1-069061 IgG1.3 HC | EVQLVESGGGLVQPGKSLRLSCAASGFTLEDYAMHWVRQAPGKGLEW VSGINWNSAEIGYADSVKGRFTISRDNAKNSLYLQMNSLRTEDTALY YCAKVPGYSGGWIDAEDDWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV |

| SEQ ID NO | Name | Sequence |
|---|---|---|
| 18 | P1-069061 LC | SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 19 | P1-069063 VH | EVQLVESGGGLVQPGKSLRLSCAASGFTLEDYAMHWVRQAPGKGLEW VSGINWNSAEIGYADSVKGRFTISRDNAKNSLYLQMNSLRTEDTALY YCAKVPGYSGGWIDADDEWGQGTMVTVSS |
| 20 | P1-069063 VL | EIVLTQSPGTLSLSPGERATLSC<u>RASQSVSSSYLA</u>WYQQKPGQAPRL LIY<u>GASSRAT</u>GIPDRFSGSGSGTDFTLTISRLEPEDFAVYYC<u>QQYGS SPFT</u>FGPGTKVDIK |
| 21 | P1-069063 IgG1.3 HC | EVQLVESGGGLVQPGKSLRLSCAASGFTLEDYAMHWVRQAPGKGLEW VSGINWNSAEIGYADSVKGRFTISRDNAKNSLYLQMNSLRTEDTALY YCAKVPGYSGGWIDADDEWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 22 | P1-069063 LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 23 | P1-069065 VH | EVQLVESGGGLVQPGKSLRLSCAASGFTLEDEAMHWVRQAPGKGLEW VSGINWNSDDIGYADSVKGRFTISRDNAKNSLYLQMNSLRTEDTALY YCAKVPGYSGGWIDAFDVWGQGTMVTVSS |
| 24 | P1-069065 VL | EIVLTQSPGTLSLSPGERATLSC<u>RASQSVSSSYLA</u>WYQQKPGQAPRL LIY<u>GASSRAT</u>GIPDRFSGSGSGTDFTLTISRLEPEDFAVYYC<u>QQYGS SPFT</u>FGPGTKVDIK |
| 25 | P1-069065 IgG1.3 HC | EVQLVESGGGLVQPGKSLRLSCAASGFTLEDEAMHWVRQAPGKGLEW VSGINWNSDDIGYADSVKGRFTISRDNAKNSLYLQMNSLRTEDTALY YCAKVPGYSGGWIDAFDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 26 | P1-069065 LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTEGPGTKVDIKRTVAAPSVFIFPPSDEQLKSGTASVVCLLNNEY PREAKVQWKVDNALQSGNSQESVTEQDSKDSTYSLSSTLTLSKADYE KHKVYACEVTHQGLSSPVTKSFNRGEC |
| 27 | P1-069067 VH | EVQLVESGGGLVQPGKSLRLSCAASGFTLDDYAMHWVRQAPGKGLEW VSGINWNSEEIGYADSVKGRFTISRDNAKNSLYLQMNSLRTEDTALY YCAKVPGYSGGWIDADDEWGQGTMVTVSS |
| 28 | P1-069067 VL | EIVLTQSPGTLSLSPGERATLSC<u>RASQSVSSSYLA</u>WYQQKPGQAPRL LIY<u>GASSRAT</u>GIPDRFSGSGSGTDFTLTISRLEPEDFAVYYC<u>QQYGS SPFT</u>FGPGTKVDIK |
| 29 | P1-069067 IgG1.3 HC | EVQLVESGGGLVQPGKSLRLSCAASGFTLDDYAMHWVRQAPGKGLEW VSGINWNSEEIGYADSVKGRFTISRDNAKNSLYLQMNSLRTEDTALY YCAKVPGYSGGWIDADDEWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 30 | P1-069067 LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 31 | P1-069069 VH | EVQLVESGGGLVQPGKSLRLSCAASGFTLDDYAMHWVRQAPGKGLEW VSGINWNSEEIGYADSVKGRFTISRDNAKNSLYLQMNSLRTEDTALY YCAK<u>VPGYSGGWIDADDV</u>WGQGTMVTVSS |

-continued

| SEQ ID NO | Name | Sequence |
|---|---|---|
| 32 | P1-069069 VL | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 33 | P1-069069 IgG1.3 HC | EVQLVESGGGLVQPGKSLRLSCAASGFTLDDYAMHWVRQAPGKGLEW VSGINWNSEEIGYADSVKGRFTISRDNAKNSLYLQMNSLRTEDTALY YCAKVPGYSGGWIDADDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 34 | P1-069069 LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 35 | P1-069071 VH | EVQLVESGGGLVQPGKSLRLSCAASGFTLEDEAMHWVRQAPGKGLEW VSGINWNSADIGYADSVKGRFTISRDNAKNSLYLQMNSLRTEDTALY YCAKVPGYSEGWIDAFDVWGQGTMVTVSS |
| 36 | P1-069071 VL | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 37 | P1-069071 IgG1.3 HC | EVQLVESGGGLVQPGKSLRLSCAASGFTLEDEAMHWVRQAPGKGLEW VSGINWNSADIGYADSVKGRFTISRDNAKNSLYLQMNSLRTEDTALY YCAKVPGYSEGWIDAFDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 38 | P1-069071 LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 39 | P1-069073 VH | EVQLVESGGGLVQPGKSLRLSCAASGFTLEDEAMHWVRQAPGKGLEW VSGINWNSAEIGYADSVKGRFTISRDNAKNSLYLQMNSLRTEDTALY YCAKVPGYSGGWIDAEDVWGQGTMVTVSS |
| 40 | P1-069073 VL | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 41 | P1-069073 IgG1.3 HC | EVQLVESGGGLVQPGKSLRLSCAASGFTLEDEAMHWVRQAPGKGLEW VSGINWNSAEIGYADSVKGRFTISRDNAKNSLYLQMNSLRTEDTALY YCAKVPGYSGGWIDAEDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 42 | P1-069073 LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 43 | P1-069075 VH | EVQLVESGGGLVQPGKSLRLSCAASGFTLEDYAMHWVRQAPGKGLEW VSGINWDSAEIGYADSVKGRFTISRDNAKNSLYLQMNSLRTEDTALY YCAKVPGYSHGWIDAEDVWGQGTMVTVSS |
| 44 | P1-069075 VL | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 45 | P1-069075 IgG1.3 HC | EVQLVESGGGLVQPGKSLRLSCAASGFTLEDYAMHWVRQAPGKGLEW VSGINWDSAEIGYADSVKGRFTISRDNAKNSLYLQMNSLRTEDTALY YCAKVPGYSHGWIDAEDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |

| SEQ ID NO | Name | Sequence |
|---|---|---|
| 46 | P1-069075 LC | EIVLTQSPGTLSLSPGERATLSCRASQSVSSSYLAWYQQKPGQAPRL<br>LIYGASSRATGIPDRFSGSGSGTDFTLTISRLEPEDFAVYYCQQYGS<br>SPFTFGPGTKVDIKRTVAAPSVFIFPPSDEQLKSGTASVVCLLNNFY<br>PREAKVQWKVDNALQSGNSQESVTEQDSKDSTYSLSSTLTLSKADYE<br>KHKVYACEVTHQGLSSPVTKSFNRGEC |
| 47 | P1-069077 VH | EVQLVESGGGLVQPGKSLRLSCAASGFTLEDEAMHWVRQAPGKGLEW<br>VSGINWNSDEIGYADSVKGRFTISRDNAKNSLYLQMNSLRTEDTALY<br>YCAKVPGYSGGWIDAFDVWGQGTMVTVSS |
| 48 | P1-069077 VL | EIVLTQSPGTLSLSPGERATLSCRASQSVSSSYLAWYQQKPGQAPRL<br>LIYGASSRATGIPDRFSGSGSGTDFTLTISRLEPEDFAVYYCQQYGS<br>SPFTFGPGTKVDIK |
| 49 | P1-069077 IgG1.3 HC | EVQLVESGGGLVQPGKSLRLSCAASGFTLEDEAMHWVRQAPGKGLEW<br>VSGINWNSDEIGYADSVKGRFTISRDNAKNSLYLQMNSLRTEDTALY<br>YCAKVPGYSGGWIDAFDVWGQGTMVTVSSASTKGPSVFPLAPSSKST<br>SGGTAALGCLVKDYFPEPVTVSWNSGALTSGVHTFPAVLQSSGLYSL<br>SSVVTVPSSSLGTQTYICNVNHKPSNTKVDKRVEPKSCDKTHTCPPC<br>PAPEAEGAPSVFLFPPKPKDTLMISRTPEVTCVVVDVSHEDPEVKFN<br>WYVDGVEVHNAKTKPREEQYNSTYRVVSVLTVLHQDWLNGKEYKCKV<br>SNKALPAPIEKTISKAKGQPREPQVYTLPPSREEMTKNQVSLTCLVK<br>GFYPSDIAVEWESNGQPENNYKTTPPVLDSDGSFFLYSKLTVDKSRW<br>QQGNVFSCSVMHEALHNHYTQKSLSLSPG |
| 50 | P1-069077 LC | EIVLTQSPGTLSLSPGERATLSCRASQSVSSSYLAWYQQKPGQAPRL<br>LIYGASSRATGIPDRFSGSGSGTDFTLTISRLEPEDFAVYYCQQYGS<br>SPFTFGPGTKVDIKRTVAAPSVFIFPPSDEQLKSGTASVVCLLNNFY<br>PREAKVQWKVDNALQSGNSQESVTEQDSKDSTYSLSSTLTLSKADYE<br>KHKVYACEVTHQGLSSPVTKSFNRGEC |
| 51 | P1-068761 VH | EVQLVESGGGLVQPGKSLRLSCAASGFTLEDEAMHWVRQAPGKGLEW<br>VSGINWNSEEIGYADSVKGRFTISRDNAKNSLYLQMNSLRTEDTALY<br>YCAKVPGYSHGWIDAEDVWGQGTMVTVSS |
| 52 | P1-068761 VL | EIVLTQSPGTLSLSPGERATLSCRASQSVSSSYLAWYQQKPGQAPRL<br>LIYGASSRATGIPDRFSGSGSGTDFTLTISRLEPEDFAVYYCQQYGS<br>SPFTFGPGTKVDIK |
| 53 | P1-068761 IgG1.3 HC | EVQLVESGGGLVQPGKSLRLSCAASGFTLEDEAMHWVRQAPGKGLEW<br>VSGINWNSEEIGYADSVKGRFTISRDNAKNSLYLQMNSLRTEDTALY<br>YCAKVPGYSHGWIDAEDVWGQGTMVTVSSASTKGPSVFPLAPSSKST<br>SGGTAALGCLVKDYFPEPVTVSWNSGALTSGVHTFPAVLQSSGLYSL<br>SSVVTVPSSSLGTQTYICNVNHKPSNTKVDKRVEPKSCDKTHTCPPC<br>PAPEAEGAPSVFLFPPKPKDTLMISRTPEVTCVVVDVSHEDPEVKFN<br>WYVDGVEVHNAKTKPREEQYNSTYRVVSVLTVLHQDWLNGKEYKCKV<br>SNKALPAPIEKTISKAKGQPREPQVYTLPPSREEMTKNQVSLTCLVK<br>GFYPSDIAVEWESNGQPENNYKTTPPVLDSDGSFFLYSKLTVDKSRW<br>QQGNVFSCSVMHEALHNHYTQKSLSLSPG |
| 54 | P1-068761 LC | EIVLTQSPGTLSLSPGERATLSCRASQSVSSSYLAWYQQKPGQAPRL<br>LIYGASSRATGIPDRFSGSGSGTDFTLTISRLEPEDFAVYYCQQYGS<br>SPFTFGPGTKVDIKRTVAAPSVFIFPPSDEQLKSGTASVVCLLNNFY<br>PREAKVQWKVDNALQSGNSQESVTEQDSKDSTYSLSSTLTLSKADYE<br>KHKVYACEVTHQGLSSPVTKSFNRGEC |
| 55 | P1-068767 VH | EVQLVESGGGLVQPGKSLRLSCAASGFTLEDYAMHWVRQAPGKGLEW<br>VSGIDWNSENIGYADSVKGRFTISRDNAKNSLYLQMNSLRTEDTALY<br>YCAKVPGYSGGWIDAEDDWGQGTMVTVSS |
| 56 | P1-068767 VL | EIVLTQSPGTLSLSPGERATLSCRASQSVSSSYLAWYQQKPGQAPRL<br>LIYGASSRATGIPDRFSGSGSGTDFTLTISRLEPEDFAVYYCQQYGS<br>SPFTFGPGTKVDIK |
| 57 | P1-068767 IgG1.3 HC | EVQLVESGGGLVQPGKSLRLSCAASGFTLEDYAMHWVRQAPGKGLEW<br>VSGIDWNSENIGYADSVKGRFTISRDNAKNSLYLQMNSLRTEDTALY<br>YCAKVPGYSGGWIDAEDDWGQGTMVTVSSASTKGPSVFPLAPSSKST<br>SGGTAALGCLVKDYFPEPVTVSWNSGALTSGVHTFPAVLQSSGLYSL<br>SSVVTVPSSSLGTQTYICNVNHKPSNTKVDKRVEPKSCDKTHTCPPC<br>PAPEAEGAPSVFLFPPKPKDTLMISRTPEVTCVVVDVSHEDPEVKFN<br>WYVDGVEVHNAKTKPREEQYNSTYRVVSVLTVLHQDWLNGKEYKCKV<br>SNKALPAPIEKTISKAKGQPREPQVYTLPPSREEMTKNQVSLTCLVK<br>GFYPSDIAVEWESNGQPENNYKTTPPVLDSDGSFFLYSKLTVDKSRW<br>QQGNVFSCSVMHEALHNHYTQKSLSLSPG |
| 58 | P1-068767 LC | EIVLTQSPGTLSLSPGERATLSCRASQSVSSSYLAWYQQKPGQAPRL<br>LIYGASSRATGIPDRFSGSGSGTDFTLTISRLEPEDFAVYYCQQYGS<br>SPFTFGPGTKVDIKRTVAAPSVFIFPPSDEQLKSGTASVVCLLNNFY<br>PREAKVQWKVDNALQSGNSQESVTEQDSKDSTYSLSSTLTLSKADYE<br>KHKVYACEVTHQGLSSPVTKSFNRGEC |
| 59 | P1-068773 VH | EVQLVESGGGLVQPGKSLRLSCAASGFTLEDYAMHWVRQAPGKGLEW<br>VSGIDWNSDNIGYADSVKGRFTISRDNAKNSLYLQMNSLRTEDTALY<br>YCAKVPGYSGGWIDAEDDWGQGTMVTVSS |
| 60 | P1-068773 VL | EIVLTQSPGTLSLSPGERATLSCRASQSVSSSYLAWYQQKPGQAPRL<br>LIYGASSRATGIPDRFSGSGSGTDFTLTISRLEPEDFAVYYCQQYGS<br>SPFTFGPGTKVDIK |

-continued

| SEQ ID NO | Name | Sequence |
|---|---|---|
| 61 | P1-068773 IgG1.3 HC | EVQLVESGGGLVQPGKSLRLSCAASGFTLEDYAMHWVRQAPGKGLEW VSGIDWNSDNIGYADSVKGRFTISRDNAKNSLYLQMNSLRTEDTALY YCAKVPGYSGGWIDAEDDWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 62 | P1-068773 LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 63 | P1-068765 VH | EVQLVESGGGLVQPGKSLRLSCAASGFTDEDYAMHWVRQAPGKGLEW VSGINWNSEEIGYADSVKGRFTISRDNAKNSLYLQMNSLRTEDTALY YCAKVPGYSGGWIDAEDDWGQGTMVTVSS |
| 64 | P1-068765 VL | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 65 | P1-068765 IgG1.3 HC | EVQLVESGGGLVQPGKSLRLSCAASGFTDEDYAMHWVRQAPGKGLEW VSGINWNSEEIGYADSVKGRFTISRDNAKNSLYLQMNSLRTEDTALY YCAKVPGYSGGWIDAEDDWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 66 | P1-068765 LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 67 | P1-061029 VH | EVQLVESGGGLVQPGKSLRLSCAASGFTLDDYAMHWVRQAPGKGLEW VSGINWNSANIGYADSVKGRFTISRDNAKNSLYLQMNSLRTEDTALY YCAKVPGYSGGWIDAFDVWGQGTMVTVSS |
| 68 | P1-061029 VL | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 69 | P1-061029 IgG1.3 HC | EVQLVESGGGLVQPGKSLRLSCAASGFTLDDYAMHWVRQAPGKGLEW VSGINWNSANIGYADSVKGRFTISRDNAKNSLYLQMNSLRTEDTALY YCAKVPGYSGGWIDAFDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 70 | P1-061029 LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 71 | P1-068757 VH | EVQLVESGGGLVQPGKSLRLSCAASGFTLEDEAMHWVRQAPGKGLEW VSGINWNSEEIGYADSVKGRFTISRDNAKNSLYLQMNSLRTEDTALY YCAKVPGYSGGWIDAEDDWGQGTMVTVSS |
| 72 | P1-068757 VL | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 73 | P1-068757 IgG1.3 HC | EVQLVESGGGLVQPGKSLRLSCAASGFTLEDEAMHWVRQAPGKGLEW VSGINWNSEEIGYADSVKGRFTISRDNAKNSLYLQMNSLRTEDTALY YCAKVPGYSGGWIDAEDDWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 74 | P1-068757 LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY |

-continued

| SEQ ID NO | Name | Sequence |
|---|---|---|
| | | PREAKVQWKVDNALQSGNSQESVTEQDSKDSTYSLSSTLTLSKADYE KHKVYACEVTHQGLSSPVTKSFNRGEC |
| 75 | P1-068771 VH | EVQLVESGGGLVQPGKSLRLSCAASGFTLEDEAMHWVRQAPGKGLEW VSGINWNSHEIGYADSVKGRFTISRDNAKNSLYLQMNSLRTEDTALY YCAKVPGYSGGWIDAEDDWGQGTMVTVSS |
| 76 | P1-068771 VL | EIVLTQSPGTLSLSPGERATLSCRASQSVSSSYLAWYQQKPGQAPRL LIYGASSRATGIPDRFSGSGSGTDFTLTISRLEPEDFAVYYC<u>QQYGS SPFT</u>FGPGTKVDIK |
| 77 | P1-068771 IgG1.3 HC | EVQLVESGGGLVQPGKSLRLSCAASGFTLEDEAMHWVRQAPGKGLEW VSGINWNSHEIGYADSVKGRFTISRDNAKNSLYLQMNSLRTEDTALY YCAKVPGYSGGWIDAEDDWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 78 | P1-068771 LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 79 | P1-068775 VH | EVQLVESGGGLVQPGKSLRLSCAASGFTLEDEAMHWVRQAPGKGLEW VSGIDWNSEEIGYADSVKGRFTISRDNAKNSLYLQMNSLRTEDTALY YCAKVPGYSHGWIDAEDDWGQGTMVTVSS |
| 80 | P1-068775 VL | EIVLTQSPGTLSLSPGERATLSCRASQSVSSSYLAWYQQKPGQAPRL LIYGASSRATGIPDRFSGSGSGTDFTLTISRLEPEDFAVYYC<u>QQYGS SPFT</u>FGPGTKVDIK |
| 81 | P1-068775 IgG1.3 HC | EVQLVESGGGLVQPGKSLRLSCAASGFTLEDEAMHWVRQAPGKGLEW VSGIDWNSEEIGYADSVKGRFTISRDNAKNSLYLQMNSLRTEDTALY YCAKVPGYSHGWIDAEDDWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 82 | P1-068775 LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 83 | P1-068769 VH | EVQLVESGGGLVQPGKSLRLSCAASGFTLEDEAMHWVRQAPGKGLEW VSGINWNSDHIGYADSVKGRFTISRDNAKNSLYLQMNSLRTEDTALY YCAKVPGYSGGWIDAEDDWGQGTMVTVSS |
| 84 | P1-068769 VL | EIVLTQSPGTLSLSPGERATLSCRASQSVSSSYLAWYQQKPGQAPRL LIYGASSRATGIPDRFSGSGSGTDFTLTISRLEPEDFAVYYC<u>QQYGS SPFT</u>FGPGTKVDIK |
| 85 | P1-068769 IgG1.3 HC | EVQLVESGGGLVQPGKSLRLSCAASGFTLEDEAMHWVRQAPGKGLEW VSGINWNSDHIGYADSVKGRFTISRDNAKNSLYLQMNSLRTEDTALY YCAKVPGYSGGWIDAEDDWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 86 | P1-068769 LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 87 | P1-068759 VH | EVQLVESGGGLVQPGKSLRLSCAASGFTLEDEAMHWVRQAPGKGLEW VSGIDWNSENIGYADSVKGRFTISRDNAKNSLYLQMNSLRTEDTALY YCAKVPGYSGGWIDAEDDWGQGTMVTVSS |
| 88 | P1-068759 VL | EIVLTQSPGTLSLSPGERATLSCRASQSVSSSYLAWYQQKPGQAPRL LIYGASSRATGIPDRFSGSGSGTDFTLTISRLEPEDFAVYYC<u>QQYGS SPFT</u>FGPGTKVDIK |
| 89 | P1-068759 IgG1.3 HC | EVQLVESGGGLVQPGKSLRLSCAASGFTLEDEAMHWVRQAPGKGLEW VSGIDWNSENIGYADSVKGRFTISRDNAKNSLYLQMNSLRTEDTALY YCAKVPGYSGGWIDAEDDWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC |

| SEQ ID NO | Name | Sequence |
|---|---|---|
| | | PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 90 | P1-068759 LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 91 | P1-068763 VH | EVQLVESGGGLVQPGKSLRLSCAASGFTLEDYAMHWVRQAPGKGLEW VSGIDWNSENIGYADSVKGRFTISRDNAKNSLYLQMNSLRTEDTALY YCAKVPGYSHGWIDAEDVWGQGTMVTVSS |
| 92 | P1-068763 VL | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 93 | P1-068763 IgG1.3 HC | EVQLVESGGGLVQPGKSLRLSCAASGFTLEDYAMHWVRQAPGKGLEW VSGIDWNSENIGYADSVKGRFTISRDNAKNSLYLQMNSLRTEDTALY YCAKVPGYSHGWIDAEDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 94 | P1-068763 LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 95 | P1-061015 VH | QVQLVESGGGVVQPGRSLRLSCAASGFTFSSYAMHWVRQAPGKGLEW VAIIWYDGSNKYYADSVKGRFTISRDNSKNTLYLQMNSLRAEDTAVY YCARDSGFYSSYYFDYWGQGTLVTVSS |
| 96 | P1-061015 VL | EIVLTQSPATLSLSPGERATLSCRASQSVSSSYLAWYQQKPGQAPRL LIYDASNRATGIPARFSGSGSGTDFTLTISSLEPEDFATYYCQQYNS YPYTFGQGTKLEIK |
| 97 | P1-061015 IgG1.3 HC | QVQLVESGGGVVQPGRSLRLSCAASGFTFSSYAMHWVRQAPGKGLEW VAIIWYDGSNKYYADSVKGRFTISRDNSKNTLYLQMNSLRAEDTAVY YCARDSGFYSSYYFDYWGQGTLVTVSSASTKGPSVFPLAPSSKSTSG GTAALGCLVKDYFPEPVTVSWNSGALTSGVHTFPAVLQSSGLYSLSS VVTVPSSSLGTQTYICNVNHKPSNTKVDKRVEPKSCDKTHTCPPCPA PEAEGAPSVFLFPPKPKDTLMISRTPEVTCVVVDVSHEDPEVKFNWY VDGVEVHNAKTKPREEQYNSTYRVVSVLTVLHQDWLNGKEYKCKVSN KALPAPIEKTISKAKGQPREPQVYTLPPSREEMTKNQVSLTCLVKGF YPSDIAVEWESNGQPENNYKTTPPVLDSDGSFFLYSKLTVDKSRWQQ GNVFSCSVMHEALHNHYTQKSLSLSPG |
| 98 | P1-061015 LC | EIVLTQSPATLSLSPGERATLSCRASQSVSSSYLAWYQQKPGQAPRL LIYDASNRATGIPARFSGSGSGTDFTLTISSLEPEDFATYYCQQYNS YPYTFGQGTKLEIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 99 | P1-068748 VH | QVQLVESGGGVVQPGRSLRLSCAASGFTFSHHAMHWVRQAPGKGLEW VAIIWYDGSNDDYADSVKGRFTISRDNSKNTLYLQMNSLRAEDTAVY YCARDSGFYDSYYFDYWGQGTLVTVSS |
| 100 | P1-068748 VL | EIVLTQSPATLSLSPGERATLSCRASQSVSSSYLAWYQQKPGQAPRL LIYDASNRATGIPARFSGSGSGTDFTLTISSLEPEDFATYYCQQYNS YPYTFGQGTKLEIK |
| 101 | P1-068748 IgG1.3 HC | QVQLVESGGGVVQPGRSLRLSCAASGFTFSHHAMHWVRQAPGKGLEW VAIIWYDGSNDDYADSVKGRFTISRDNSKNTLYLQMNSLRAEDTAVY YCARDSGFYDSYYFDYWGQGTLVTVSSASTKGPSVFPLAPSSKSTSG GTAALGCLVKDYFPEPVTVSWNSGALTSGVHTFPAVLQSSGLYSLSS VVTVPSSSLGTQTYICNVNHKPSNTKVDKRVEPKSCDKTHTCPPCPA PEAEGAPSVFLFPPKPKDTLMISRTPEVTCVVVDVSHEDPEVKFNWY VDGVEVHNAKTKPREEQYNSTYRVVSVLTVLHQDWLNGKEYKCKVSN KALPAPIEKTISKAKGQPREPQVYTLPPSREEMTKNQVSLTCLVKGF YPSDIAVEWESNGQPENNYKTTPPVLDSDGSFFLYSKLTVDKSRWQQ GNVFSCSVMHEALHNHYTQKSLSLSPG |
| 102 | P1-068748 LC | EIVLTQSPATLSLSPGERATLSCRASQSVSSSYLAWYQQKPGQAPRL LIYDASNRATGIPARFSGSGSGTDFTLTISSLEPEDFATYYCQQYNS YPYTFGQGTKLEIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 103 | P1-068744 VH | QVQLVESGGGVVQPGRSLRLSCAASGFTFSEYAMHWVRQAPGKGLEW VAHIWYDGSNKYEADSVKGRFTISRDNSKNTLYLQMNSLRAEDTAVY YCARDSGFYESYYFDEWGQGTLVTVSS |

| SEQ ID NO | Name | Sequence |
|---|---|---|
| 104 | P1-068744 VL | EIVLTQSPATLSLSPGERATLSCRASQSVSSSYLAWYQQKPGQAPRL LIYDASNRATGIPARFSGSGSGTDFTLTISSLEPEDFATYYCQQYNS YPYTFGQGTKLEIK |
| 105 | P1-068744 IgG1.3 HC | QVQLVESGGGVVQPGRSLRLSCAASGFTFSEYAMHWVRQAPGKGLEW VAHIWYDGSNKYEADSVKGRFTISRDNSKNTLYLQMNSLRAEDTAVY YCARDSGFYESYYFDEWGQGTLVTVSSASTKGPSVFPLAPSSKSTSG GTAALGCLVKDYFPEPVTVSWNSGALTSGVHTFPAVLQSSGLYSLSS VVTVPSSSLGTQTYICNVNHKPSNTKVDKRVEPKSCDKTHTCPPCPA PEAEGAPSVFLFPPKPKDTLMISRTPEVTCVVVDVSHEDPEVKFNWY VDGVEVHNAKTKPREEQYNSTYRVVSVLTVLHQDWLNGKEYKCKVSN KALPAPIEKTISKAKGQPREPQVYTLPPSREEMTKNQVSLTCLVKGF YPSDIAVEWESNGQPENNYKTTPPVLDSDGSFFLYSKLTVDKSRWQQ GNVFSCSVMHEALHNHYTQKSLSLSPG |
| 106 | P1-068744 LC | EIVLTQSPATLSLSPGERATLSCRASQSVSSSYLAWYQQKPGQAPRL LIYDASNRATGIPARFSGSGSGTDFTLTISSLEPEDFATYYCQQYNS YPYTFGQGTKLEIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 107 | P1-068736 VH | QVQLVESGGGVVQPGRSLRLSCAASGFTFSEYAMHWVRQAPGKGLEW VAIDWYDGSNKDYADSVKGRFTISRDNSKNTLYLQMNSLRAEDTAVY YCARDSGFYDSYYFDDWGQGTLVTVSS |
| 108 | P1-068736 VL | EIVLTQSPATLSLSPGERATLSCRASQSVSSSYLAWYQQKPGQAPRL LIYDASNRATGIPARFSGSGSGTDFTLTISSLEPEDFATYYCQQYNS YPYTFGQGTKLEIK |
| 109 | P1-068736 IgG1.3 HC | QVQLVESGGGVVQPGRSLRLSCAASGFTFSEYAMHWVRQAPGKGLEW VAIDWYDGSNKDYADSVKGRFTISRDNSKNTLYLQMNSLRAEDTAVY YCARDSGFYDSYYFDDWGQGTLVTVSSASTKGPSVFPLAPSSKSTSG GTAALGCLVKDYFPEPVTVSWNSGALTSGVHTFPAVLQSSGLYSLSS VVTVPSSSLGTQTYICNVNHKPSNTKVDKRVEPKSCDKTHTCPPCPA PEAEGAPSVFLFPPKPKDTLMISRTPEVTCVVVDVSHEDPEVKFNWY VDGVEVHNAKTKPREEQYNSTYRVVSVLTVLHQDWLNGKEYKCKVSN KALPAPIEKTISKAKGQPREPQVYTLPPSREEMTKNQVSLTCLVKGF YPSDIAVEWESNGQPENNYKTTPPVLDSDGSFFLYSKLTVDKSRWQQ GNVFSCSVMHEALHNHYTQKSLSLSPG |
| 110 | P1-068736 LC | EIVLTQSPATLSLSPGERATLSCRASQSVSSSYLAWYQQKPGQAPRL LIYDASNRATGIPARFSGSGSGTDFTLTISSLEPEDFATYYCQQYNS YPYTFGQGTKLEIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 111 | P1-068752 VH | QVQLVESGGGVVQPGRSLRLSCAASGFTFSSYAMHWVRQAPGKGLEW VAEIWYDGSNKDYADSVKGRFTISRDNSKNTLYLQMNSLRAEDTAVY YCARDSGFYDSYYFDEWGQGTLVTVSS |
| 112 | P1-068752 VL | EIVLTQSPATLSLSPGERATLSCRASQSVSSSYLAWYQQKPGQAPRL LIYDASNRATGIPARFSGSGSGTDFTLTISSLEPEDFATYYCQQYNS YPYTFGQGTKLEIK |
| 113 | P1-068752 IgG1.3 HC | QVQLVESGGGVVQPGRSLRLSCAASGFTFSSYAMHWVRQAPGKGLEW VAEIWYDGSNKDYADSVKGRFTISRDNSKNTLYLQMNSLRAEDTAVY YCARDSGFYDSYYFDEWGQGTLVTVSSASTKGPSVFPLAPSSKSTSG GTAALGCLVKDYFPEPVTVSWNSGALTSGVHTFPAVLQSSGLYSLSS VVTVPSSSLGTQTYICNVNHKPSNTKVDKRVEPKSCDKTHTCPPCPA PEAEGAPSVFLFPPKPKDTLMISRTPEVTCVVVDVSHEDPEVKFNWY VDGVEVHNAKTKPREEQYNSTYRVVSVLTVLHQDWLNGKEYKCKVSN KALPAPIEKTISKAKGQPREPQVYTLPPSREEMTKNQVSLTCLVKGF YPSDIAVEWESNGQPENNYKTTPPVLDSDGSFFLYSKLTVDKSRWQQ GNVFSCSVMHEALHNHYTQKSLSLSPG |
| 114 | P1-068752 LC | EIVLTQSPATLSLSPGERATLSCRASQSVSSSYLAWYQQKPGQAPRL LIYDASNRATGIPARFSGSGSGTDFTLTISSLEPEDFATYYCQQYNS YPYTFGQGTKLEIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 115 | P1-068740 VH | QVQLVESGGGVVQPGRSLRLSCAASGFTFSDYAMHWVRQAPGKGLEW VAIIWYDGSDKDYADSVKGRFTISRDNSKNTLYLQMNSLRAEDTAVY YCARDSGFYDSYYFDDWGQGTLVTVSS |
| 116 | P1-068740 VL | EIVLTQSPATLSLSPGERATLSCRASQSVSSSYLAWYQQKPGQAPRL LIYDASNRATGIPARFSGSGSGTDFTLTISSLEPEDFATYYCQQYNS YPYTFGQGTKLEIK |
| 117 | P1-068740 IgG1.3 HC | QVQLVESGGGVVQPGRSLRLSCAASGFTFSDYAMHWVRQAPGKGLEW VAIIWYDGSDKDYADSVKGRFTISRDNSKNTLYLQMNSLRAEDTAVY YCARDSGFYDSYYFDDWGQGTLVTVSSASTKGPSVFPLAPSSKSTSG GTAALGCLVKDYFPEPVTVSWNSGALTSGVHTFPAVLQSSGLYSLSS VVTVPSSSLGTQTYICNVNHKPSNTKVDKRVEPKSCDKTHTCPPCPA PEAEGAPSVFLFPPKPKDTLMISRTPEVTCVVVDVSHEDPEVKFNWY VDGVEVHNAKTKPREEQYNSTYRVVSVLTVLHQDWLNGKEYKCKVSN KALPAPIEKTISKAKGQPREPQVYTLPPSREEMTKNQVSLTCLVKGF YPSDIAVEWESNGQPENNYKTTPPVLDSDGSFFLYSKLTVDKSRWQQ GNVFSCSVMHEALHNHYTQKSLSLSPG |

| SEQ ID NO | Name | Sequence |
|---|---|---|
| 118 | P1-068740 LC | EIVLTQSPATLSLSPGERATLSCRASQSVSSSYLAWYQQKPGQAPRL<br>LIYDASNRATGIPARFSGSGSGTDFTLTISSLEPEDFATYYCQQYNS<br>YPYTFGQGTKLEIKRTVAAPSVFIFPPSDEQLKSGTASVVCLLNNFY<br>PREAKVQWKVDNALQSGNSQESVTEQDSKDSTYSLSSTLTLSKADYE<br>KHKVYACEVTHQGLSSPVTKSFNRGEC |
| 119 | P1-068742 VH | QVQLVESGGGVVQPGRSLRLSCAASGFTESDYAMHWVRQAPGKGLEW<br>VAIIWYDGSDKDYADSVKGRFTISRDNSKNTLYLQMNSLRAEDTAVY<br>YCARDSGFYEDYYFDYWGQGTLVTVSS |
| 120 | P1-068742 VL | EIVLTQSPATLSLSPGERATLSCRASQSVSSSYLAWYQQKPGQAPRL<br>LIYDASNRATGIPARFSGSGSGTDFTLTISSLEPEDFATYYCQQYNS<br>YPYTFGQGTKLEIK |
| 121 | P1-068742 IgG1.3 HC | QVQLVESGGGVVQPGRSLRLSCAASGFTFSDYAMHWVRQAPGKGLEW<br>VAIIWYDGSDKDYADSVKGRFTISRDNSKNTLYLQMNSLRAEDTAVY<br>YCARDSGFYEDYYFDYWGQGTLVTVSSASTKGPSVFPLAPSSKSTSG<br>GTAALGCLVKDYFPEPVTVSWNSGALTSGVHTFPAVLQSSGLYSLSS<br>VVTVPSSSLGTQTYICNVNHKPSNTKVDKRVEPKSCDKTHTCPPCPA<br>PEAEGAPSVFLFPPKPKDTLMISRTPEVTCVVVDVSHEDPEVKFNWY<br>VDGVEVHNAKTKPREEQYNSTYRVVSVLTVLHQDWLNGKEYKCKVSN<br>KALPAPIEKTISKAKGQPREPQVYTLPPSREEMTKNQVSLTCLVKGF<br>YPSDIAVEWESNGQPENNYKTTPPVLDSDGSFFLYSKLTVDKSRWQQ<br>GNVFSCSVMHEALHNHYTQKSLSLSPG |
| 122 | P1-068742 LC | EIVLTQSPATLSLSPGERATLSCRASQSVSSSYLAWYQQKPGQAPRL<br>LIYDASNRATGIPARFSGSGSGTDFTLTISSLEPEDFATYYCQQYNS<br>YPYTFGQGTKLEIKRTVAAPSVFIFPPSDEQLKSGTASVVCLLNNFY<br>PREAKVQWKVDNALQSGNSQESVTEQDSKDSTYSLSSTLTLSKADYE<br>KHKVYACEVTHQGLSSPVTKSFNRGEC |
| 123 | P1-068746 VH | QVQLVESGGGVVQPGRSLRLSCAASGFTESSYAMHWVRQAPGKGLEW<br>VAIIWYDGSNEHYADSVKGRFTISRDNSKNTLYLQMNSLRAEDTAVY<br>YCARDSGFYDSYYFDYWGQGTLVTVSS |
| 124 | P1-068746 VL | EIVLTQSPATLSLSPGERATLSCRASQSVSSSYLAWYQQKPGQAPRL<br>LIYDASNRATGIPARFSGSGSGTDFTLTISSLEPEDFATYYCQQYNS<br>YPYTFGQGTKLEIK |
| 125 | P1-068746 IgG1.3 HC | QVQLVESGGGVVQPGRSLRLSCAASGFTFSSYAMHWVRQAPGKGLEW<br>VAIIWYDGSNHHYADSVKGRFTISRDNSKNTLYLQMNSLRAEDTAVY<br>YCARDSGFYDSYYFDYWGQGTLVTVSSASTKGPSVFPLAPSSKSTSG<br>GTAALGCLVKDYFPEPVTVSWNSGALTSGVHTFPAVLQSSGLYSLSS<br>VVTVPSSSLGTQTYICNVNHKPSNTKVDKRVEPKSCDKTHTCPPCPA<br>PEAEGAPSVFLFPPKPKDTLMISRTPEVTCVVVDVSHEDPEVKFNWY<br>VDGVEVHNAKTKPREEQYNSTYRVVSVLTVLHQDWLNGKEYKCKVSN<br>KALPAPIEKTISKAKGQPREPQVYTLPPSREEMTKNQVSLTCLVKGF<br>YPSDIAVEWESNGQPENNYKTTPPVLDSDGSFFLYSKLTVDKSRWQQ<br>GNVFSCSVMHEALHNHYTQKSLSLSPG |
| 126 | P1-068746 LC | EIVLTQSPATLSLSPGERATLSCRASQSVSSSYLAWYQQKPGQAPRL<br>LIYDASNRATGIPARFSGSGSGTDFTLTISSLEPEDFATYYCQQYNS<br>YPYTFGQGTKLEIKRTVAAPSVFIFPPSDEQLKSGTASVVCLLNNFY<br>PREAKVQWKVDNALQSGNSQESVTEQDSKDSTYSLSSTLTLSKADYE<br>KHKVYACEVTHQGLSSPVTKSFNRGEC |
| 127 | P1-068750 VH | QVQLVESGGGVVQPGRSLRLSCAASGFTESDYDMHWVRQAPGKGLEW<br>VAEIWDDGSNKYYADSVKGRFTISRDNSKNTLYLQMNSLRAEDTAVY<br>YCARDEEFYSSYYFDYWGQGTLVTVSS |
| 128 | P1-068750 VL | EIVLTQSPATLSLSPGERATLSCRASQSVSSSYLAWYQQKPGQAPRL<br>LIYDASNRATGIPARFSGSGSGTDFTLTISSLEPEDFATYYCQQYNS<br>YPYTFGQGTKLEIK |
| 129 | P1-068750 IgG1.3 HC | QVQLVESGGGVVQPGRSLRLSCAASGFTFSDYDMHWVRQAPGKGLEW<br>VAEIWDDGSNKYYADSVKGRFTISRDNSKNTLYLQMNSLRAEDTAVY<br>YCARDEEFYSSYYFDYWGQGTLVTVSSASTKGPSVFPLAPSSKSTSG<br>GTAALGCLVKDYFPEPVTVSWNSGALTSGVHTFPAVLQSSGLYSLSS<br>VVTVPSSSLGTQTYICNVNHKPSNTKVDKRVEPKSCDKTHTCPPCPA<br>PEAEGAPSVFLFPPKPKDTLMISRTPEVTCVVVDVSHEDPEVKFNWY<br>VDGVEVHNAKTKPREEQYNSTYRVVSVLTVLHQDWLNGKEYKCKVSN<br>KALPAPIEKTISKAKGQPREPQVYTLPPSREEMTKNQVSLTCLVKGF<br>YPSDIAVEWESNGQPENNYKTTPPVLDSDGSFFLYSKLTVDKSRWQQ<br>GNVFSCSVMHEALHNHYTQKSLSLSPG |
| 130 | P1-068750 LC | EIVLTQSPATLSLSPGERATLSCRASQSVSSSYLAWYQQKPGQAPRL<br>LIYDASNRATGIPARFSGSGSGTDFTLTISSLEPEDFATYYCQQYNS<br>YPYTFGQGTKLEIKRTVAAPSVFIFPPSDEQLKSGTASVVCLLNNFY<br>PREAKVQWKVDNALQSGNSQESVTEQDSKDSTYSLSSTLTLSKADYE<br>KHKVYACEVTHQGLSSPVTKSFNRGEC |
| 131 | P1-068738 VH | QVQLVESGGGVVQPGRSLRLSCAASGFTFSEYAHHWVRQAPGKGLEW<br>VAIIWDDGSNHYYADSVKGRFTISRDNSKNTLYLQMNSLRAEDTAVY<br>YCARDSGFYEDYYFDYWGQGTLVTVSS |
| 132 | P1-068738 VL | EIVLTQSPATLSLSPGERATLSCRASQSVSSSYLAWYQQKPGQAPRL<br>LIYDASNRATGIPARFSGSGSGTDFTLTISSLEPEDFATYYCQQYNS<br>YPYTFGQGTKLEIK |

-continued

| SEQ ID NO | Name | Sequence |
|---|---|---|
| 133 | P1-068738 IgG1.3 HC | QVQLVESGGGVVQPGRSLRLSCAASGFTFSEYAHHWVRQAPGKGLEW VAIIWDDGSNHYYADSVKGRFTISRDNSKNTLYLQMNSLRAEDTAVY YCARDSGFYEDYYFDYWGQGTLVTVSSASTKGPSVFPLAPSSKSTSG GTAALGCLVKDYFPEPVTVSWNSGALTSGVHTFPAVLQSSGLYSLSS VVTVPSSSLGTQTYICNVNHKPSNTKVDKRVEPKSCDKTHTCPPCPA PEAEGAPSVFLFPPKPKDTLMISRTPEVTCVVVDVSHEDPEVKFNWY VDGVEVHNAKTKPREEQYNSTYRVVSVLTVLHQDWLNGKEYKCKVSN KALPAPIEKTISKAKGQPREPQVYTLPPSREEMTKNQVSLTCLVKGF YPSDIAVEWESNGQPENNYKTTPPVLDSDGSFFLYSKLTVDKSRWQQ GNVFSCSVMHEALHNHYTQKSLSLSPG |
| 134 | P1-068738 LC | EIVLTQSPATLSLSPGERATLSCRASQSVSSSYLAWYQQKPGQAPRL LIYDASNRATGIPARFSGSGSGTDFTLTISSLEPEDFATYYCQQYNS YPYTFGQGTKLEIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 135 | P1-068754 VH | QVQLVESGGGVVQPGRSLRLSCAASGFTFSDYDMHWVRQAPGKGLEW VAEIWDDGSNKYYADSVKGRFTISRDNSKNTLYLQMNSLRAEDTAVY YCARDSGFHSDYYFDYWGQGTLVTVSS |
| 136 | P1-068754 VL | EIVLTQSPATLSLSPGERATLSCRASQSVSSSYLAWYQQKPGQAPRL LIYDASNRATGIPARFSGSGSGTDFTLTISSLEPEDFATYYCQQYNS YPYTFGQGTKLEIK |
| 137 | P1-068754 IgG1.3 HC | QVQLVESGGGVVQPGRSLRLSCAASGFTFSDYDMHWVRQAPGKGLEW VAEIWDDGSNKYYADSVKGRFTISRDNSKNTLYLQMNSLRAEDTAVY YCARDSGFHSDYYFDYWGQGTLVTVSSASTKGPSVFPLAPSSKSTSG GTAALGCLVKDYFPEPVTVSWNSGALTSGVHTFPAVLQSSGLYSLSS VVTVPSSSLGTQTYICNVNHKPSNTKVDKRVEPKSCDKTHTCPPCPA PEAEGAPSVFLFPPKPKDTLMISRTPEVTCVVVDVSHEDPEVKFNWY VDGVEVHNAKTKPREEQYNSTYRVVSVLTVLHQDWLNGKEYKCKVSN KALPAPIEKTISKAKGQPREPQVYTLPPSREEMTKNQVSLTCLVKGF YPSDIAVEWESNGQPENNYKTTPPVLDSDGSFFLYSKLTVDKSRWQQ GNVFSCSVMHEALHNHYTQKSLSLSPG |
| 138 | P1-068754 LC | EIVLTQSPATLSLSPGERATLSCRASQSVSSSYLAWYQQKPGQAPRL LIYDASNRATGIPARFSGSGSGTDFTLTISSLEPEDFATYYCQQYNS YPYTFGQGTKLEIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 139 | P1-069293 VH | EVQLVESGGGLVQPGKSLRLSCAASGFTLEDEAMHWVRQAPGKGLEW VSGINWNSEEIGYADSVKGRFTISRDNAKNSLYLQMNSLRTEDTALY YCAKVPGYSHGWIDAEDVWGQGTMVTVSS |
| 140 | P1-069293 VL (P1-068761.IgG1f) | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 141 | P1-069293 HC (P1-068761.IgG1f) | EVQLVESGGGLVQPGKSLRLSCAASGFTLEDEAMHWVRQAPGKGLEW VSGINWNSEEIGYADSVKGRFTISRDNAKNSLYLQMNSLRTEDTALY YCAKVPGYSHGWIDAEDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPELLGGPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 142 | P1-069293 LC (P1-068761.IgG1f) | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 143 | P1-069298 VH (P1-068767.IgG1f) | EVQLVESGGGLVQPGKSLRLSCAASGFTLEDYAMHWVRQAPGKGLEW VSGIDWNSENIGYADSVKGRFTISRDNAKNSLYLQMNSLRTEDTALY YCAKVPGYSGGWIDAEDDWGQGTMVTVSS |
| 144 | P1-069298 VL (P1-068767.IgG1f) | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 145 | P1-069298 HC (P1-068767.IgG1f) | EVQLVESGGGLVQPGKSLRLSCAASGFTLEDYAMHWVRQAPGKGLEW VSGIDWNSENIGYADSVKGRFTISRDNAKNSLYLQMNSLRTEDTALY YCAKVPGYSGGWIDAEDDWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPELLGGPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |

-continued

| SEQ ID NO | Name | Sequence |
|---|---|---|
| 146 | P1-069298 LC (P1-068767.IgG1f) | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 147 | P1-069302 VH (P1-061029.IgG1f) | EVQLVESGGGLVQPGKSLRLSCAASGFTLDDYAMHWVRQAPGKGLEW VSGINWNSANIGYADSVKGRFTISRDNAKNSLYLQMNSLRTEDTALY YCAKVPGYSGGWIDAFDVWGQGTMVTVSS |
| 148 | P1-069302 VL (P1-061-29.IgG1f) | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 149 | P1-069302 HC (P1-061029.IgG1f) | EVQLVESGGGLVQPGKSLRLSCAASGFTLDDYAMHWVRQAPGKGLEW VSGINWNSANIGYADSVKGRFTISRDNAKNSLYLQMNSLRTEDTALY YCAKVPGYSGGWIDAFDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPELLGGPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 150 | P1-069302 LC (P1-061029.IgG1f) | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 151 | P1-069312 VH (P1-068761.IgG1f afucosylated) | EVQLVESGGGLVQPGKSLRLSCAASGFTLEDEAMHWVRQAPGKGLEW VSGINWNSEEIGYADSVKGRFTISRDNAKNSLYLQMNSLRTEDTALY YCAKVPGYSHGWIDAEDVWGQGTMVTVSS |
| 152 | P1-069312 VL (P1-068761.IgG1f afucosylated) | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 153 | P1-069312 HC (P1-068761.IgG1f afucosylated) | EVQLVESGGGLVQPGKSLRLSCAASGFTLEDEAMHWVRQAPGKGLEW VSGINWNSEEIGYADSVKGRFTISRDNAKNSLYLQMNSLRTEDTALY YCAKVPGYSHGWIDAEDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPELLGGPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 154 | P1-069312 LC (P1-068761.IgG1f afucosylated) | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 155 | P1-069309 VH (P1-068767.IgG1f afucosylated) | EVQLVESGGGLVQPGKSLRLSCAASGFTLEDYAMHWVRQAPGKGLEW VSGIDWNSENIGYADSVKGRFTISRDNAKNSLYLQMNSLRTEDTALY YCAKVPGYSGGWIDAEDDWGQGTMVTVSS |
| 156 | P1-069309 VL (P1-068767.IgG1f afucosylated) | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 157 | P1-069309 HC P1-068767.IgG1f afucosylated) | EVQLVESGGGLVQPGKSLRLSCAASGFTLEDYAMHWVRQAPGKGLEW VSGIDWNSENIGYADSVKGRFTISRDNAKNSLYLQMNSLRTEDTALY YCAKVPGYSGGWIDAEDDWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPELLGGPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 158 | P1-069309 LC (P1-068767.IgG1f afucosylated) | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 159 | P1-069307 VH (P1-061029.IgG1f afucosylated) | EVQLVESGGGLVQPGKSLRLSCAASGFTLDDYAMHWVRQAPGKGLEW VSGINWNSANIGYADSVKGRFTISRDNAKNSLYLQMNSLRTEDTALY YCAKVPGYSGGWIDAFDVWGQGTMVTVSS |
| 160 | P1-069307 VL (P1-061029.IgG1f afucosylated) | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |

| SEQ ID NO | Name | Sequence |
|---|---|---|
| 161 | P1-069307 HC (P1-061019.IgG1f afucosylated) | EVQLVESGGGLVQPGKSLRLSCAASGFTLDDYAMHWVRQAPGKGLEW VSGINWNSANIGYADSVKGRFTISRDNAKNSLYLQMNSLRTEDTALY YCAKVPGYSGGWIDAFDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPELLGGPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 162 | P1-069307 LC (P1-061029.IgG1f afucosylated) | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTEGPGTKVDIKRTVAAPSVFIFPPSDEQLKSGTASVVCLLNNEY PREAKVQWKVDNALQSGNSQESVTEQDSKDSTYSLSSTLTLSKADYE KHKVYACEVTHQGLSSPVTKSFNRGEC |
| 163 | IgG1.3 (or IgG1.3f) heavy chain constant region (L234A, G237A) | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKRVEPKSCDKTHTCPPCPAPEAEGAPSVFLFPPKPKDTLMISRTPE VTCVVVDVSHEDPEVKFNWYVDGVEVHNAKTKPREEQYNSTYRVVSV LTVLHQDWLNGKEYKCKVSNKALPAPIEKTISKAKGQPREPQVYTLP PSREEMTKNQVSLTCLVKGFYPSDIAVEWESNGQPENNYKTTPPVLD SDGSFFLYSKLTVDKSRWQQGNVFSCSVMHEALHNHYTQKSLSLSPG |
| 164 | Exemplary light chain constant region | RTVAAPSVFIFPPSDEQLKSGTASVVCLLNNFYPREAKVQWKVDNAL QSGNSQESVTEQDSKDSTYSLSSTLTLSKADYEKHKVYACEVTHQGL SSPVTKSFNRGEC |
| 165 | Human VISTA NP_071436.1 (GIG. 1B) | See FIG. 1B |
| 166 | Cyno VISTA XP_005565644.1 (FIG. 1B) | See FIG. 1B |
| 167 | Mouse VISTA NP_083008.1 (FIG. 1B) | See FIG. 1B |
| 168 | P1-061029 HDR3 chip oligo (FIG. 7A) | <u>X</u>PGYSGGWIDAFDV |
| 169 | P1-061029 HDR3 chip oligo (FIG. 7A) | <u>XX</u>GYSGGWIDAFDV |
| 170 | P1-061029 HDR3 chip oligo (FIG. 7A) | <u>X</u>P<u>X</u>YSGGWIDAFDV |
| 171 | P1-061029 HDR3 chiop oligo (FIG. 7A) | <u>X</u>PG<u>X</u>SGGWIDAFDV |
| 172 | P1-061029 HDR3 chip oligo (FIG. 7A) | <u>X</u>PGY<u>X</u>GGWIDAFDV |
| 173 | P1-061029 HDR3 chip oligo (FIG. 7A) | <u>X</u>PGYS<u>X</u>GWIDAFDV |
| 174 | P1-061029 HDR3 chiop oligo (FIG. 7A) | <u>X</u>PGYSG<u>X</u>WIDAFDV |
| 175 | P1-061029 HDR3 chip oligo (FIG. 7A) | <u>X</u>PGYSGG<u>X</u>IDAFDV |
| 176 | P1-061029 HDR3 chipo oligo (FIG. 7A) | <u>X</u>PGYSGGS<u>X</u>DAFDV |
| 177 | P1-061029 HDR3 chip oligo (FIG. 7A) | <u>X</u>PGYSGGWI<u>X</u>AFDV |
| 178 | P1-061029 HDR3 chipo oligo (FIG. 7A) | <u>X</u>PGYSGGWID<u>X</u>FDV |
| 179 | P1-061029 HDR3 chip oligo (FIG. 7A) | <u>X</u>PGYSGGWIDA<u>X</u>DV |
| 180 | P1-061029 HDR3 chiop oligo (FIG. 7A) | <u>X</u>PGYSGGWIDAF<u>X</u>V |
| 181 | P1-061029 HDR3 chip oligo (FIG. 7A) | <u>X</u>PGYSGGWIDAFD<u>X</u> |

| SEQ ID NO | Name | Sequence |
|---|---|---|
| 182 | IgG1f (human wild-type allotype f) heavy chain constant region | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKRVEPKSCDKTHTCPPCPAPELLGGPSVFLFPPKPKDTLMISRTPE VTCVVVDVSHEDPEVKFNWYVDGVEVHNAKTKPREEQYNSTYRVVSV LTVLHQDWLNGKEYKCKVSNKALPAPIEKTISKAKGQPREPQVYTLP PSREEMTKNQVSLTCLVKGFYPSDIAVEWESNGQPENNYKTTPPVLD SDGSFFLYSKLTVDKSRWQQGNVFSCSVMHEALHNHYTQKSLSLSPG |
| 183 | IgG1.if Heavy chain constant region (L234A, L235E, G237A, A330S, P331S) | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKRVEPKSCDKTHTCPPCPAPEAEGAPSVFLFPPKPKDTLMISRTPE VTCVVVDVSHEDPEVKFNWYVDGVEVHNAKTKPREEQYNSTYRVVSV LTVLHQDWLNGKEYKCKVSNKALPSSIEKTISKAKGQPREPQVYTLP PSREEMTKNQVSLTCLVKGFYPSDIAVEWESNGQPENNYKTTPPVLD SDGSFFLYSKLTVDKSRWQQGNVFSCSVMHEALHNHYTQKSLSLSPG |
| 184 | IgG1fa.P238K (or chain constant region | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKRVEPKSCDKTHTCPPCPAPELLGGKSVFLFPPKPKDTLMISRTPE VTCVVVDVSHEDPEVKFNWYVDGVEVHNAKTKPREEQYNSTYRVVSV LTVLHQDWLNGKEYKCKVSNKALPAPIEKTISKAKGQPREPQVYTLP PSRDELTKNQVSLTCLVKGFYPSDIAVEWESNGQPENNYKTTPPVLD SDGSFFLYSKLTVDKSRWQQGNVFSCSVMHEALHNHYTQKSLSLSPG |
| 185 | P1-070864 P1-068761_E30D VH | EVQLVESGGGLVQPGKSLRLSCAASGFTLDDEAMHWVRQAPGKGLEW VSGINWNSEEIGYADSVKGRFTISRDNAKNSLYLQMNSLRTEDTALY YCAKVPGYSHGWIDAEDVWGQGTMVTVSS |
| 186 | P1-070864 P1-068761_E30D VL | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 187 | P1-070864 P1-068761_E30D IgG1.3 HC | EVQLVESGGGLVQPGKSLRLSCAASGFTLDDEAMHWVRQAPGKGLEW VSGINWNSEEIGYADSVKGRFTISRDNAKNSLYLQMNSLRTEDTALY YCAKVPGYSHGWIDAEDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 188 | P1-070864 P1-068761_E30D LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 189 | P1-070866 P1-068761_E32Y VH | EVQLVESGGGLVQPGKSLRLSCAASGFTLEDYAMHWVRQAPGKGLEW VSGINWNSEEIGYADSVKGRFTISRDNAKNSLYLQMNSLRTEDTALY YCAKVPGYSHGWIDAEDVWGQGTMVTVSS |
| 190 | P1-070866 P1-068761_E32Y VL | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 191 | P1-070866 P1-068761_E32Y IgG1.3 HC | EVQLVESGGGLVQPGKSLRLSCAASGFTLEDYAMHWVRQAPGKGLEW VSGINWNSEEIGYADSVKGRFTISRDNAKNSLYLQMNSLRTEDTALY YCAKVPGYSHGWIDAEDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 192 | P1-070866 P1-068761_E32Y LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 193 | P1-070868 P1-068761_E55A VH | EVQLVESGGGLVQPGKSLRLSCAASGFTLEDEAMHWVRQAPGKGLEW VSGINWNSAEIGYADSVKGRFTISRDNAKNSLYLQMNSLRTEDTALY YCAKVPGYSHGWIDAEDVWGQGTMVTVSS |
| 194 | P1-070868 P1-068761_E55A VL | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 195 | P1-070868 P1-068761_E55A IgG1.3 HC | EVQLVESGGGLVQPGKSLRLSCAASGFTLEDEAMHWVRQAPGKGLEW VSGINWNSAEIGYADSVKGRFTISRDNAKNSLYLQMNSLRTEDTALY YCAKVPGYSHGWIDAEDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV |

| SEQ ID NO | Name | Sequence |
|---|---|---|
| | | SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 196 | P1-070868 P1-068761_E55A LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 197 | P1-070870 P1-068761_E56N VH | EVQLVESGGGLVQPGKSLRLSCAASGFTLEDEAMHWVRQAPGKGLEW VSGINWNSENIGYADSVKGRFTISRDNAKNSLYLQMNSLRTEDTALY YCAKVPGYSHGWIDAEDVWGQGTMVTVSS |
| 198 | P1-070870 P1-068761_E56N VL | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 199 | P1-070870 P1-068761_E56N IgG1.3 HC | EVQLVESGGGLVQPGKSLRLSCAASGFTLEDEAMHWVRQAPGKGLEW VSGINWNSENIGYADSVKGRFTISRDNAKNSLYLQMNSLRTEDTALY YCAKVPGYSHGWIDAEDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 200 | P1-070870 P1-068761_E56N LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 201 | P1-070872 P1-068761_H100G VH | EVQLVESGGGLVQPGKSLRLSCAASGFTLEDEAMHWVRQAPGKGLEW VSGINWNSEEIGYADSVKGRFTISRDNAKNSLYLQMNSLRTEDTALY YCAKVPGYSGGWIDAEDVWGQGTMVTVSS |
| 202 | P1-070872 P1-068761_H100G VL | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 203 | P1-070872 P1-068761_H100G IgG1.3 HC | EVQLVESGGGLVQPGKSLRLSCAASGFTLEDEAMHWVRQAPGKGLEW VSGINWNSEEIGYADSVKGRFTISRDNAKNSLYLQMNSLRTEDTALY YCAKVPGYSGGWIDAEDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 204 | P1-070872 P1-068761_H100G LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 205 | P1-070874 P1-068761_E100fF VH | EVQLVESGGGLVQPGKSLRLSCAASGFTLEDEAMHWVRQAPGKGLEW VSGINWNSEEIGYADSVKGRFTISRDNAKNSLYLQMNSLRTEDTALY YCAKVPGYSHGWIDAFDVWGQGTMVTVSS |
| 206 | P1-070874 P1-068761_E100fF VL | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 207 | P1-070874 P1-068761_E100fF IgG1.3 HC | EVQLVESGGGLVQPGKSLRLSCAASGFTLEDEAMHWVRQAPGKGLEW VSGINWNSEEIGYADSVKGRFTISRDNAKNSLYLQMNSLRTEDTALY YCAKVPGYSHGWIDAFDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 208 | P1-070874 P1-068761_E100fF LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 209 | P1-070876 P1-068761_E30D_E32Y VH | EVQLVESGGGLVQPGKSLRLSCAASGFILDDYAMHWVRQAPGKGLEW VSGINWNSEEIGYADSVKGRETISRDNAKNSLYLQMNSLRTEDTALY YCAKVPGYSHGWIDAEDVWGQGTMVTVSS |

| SEQ ID NO | Name | Sequence |
|---|---|---|
| 210 | P1-070876 P1-068761_E30D_E32Y VL | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 211 | P1-070876 P1-068761_E30D_E32Y IgG1.3 HC | EVQLVESGGGLVQPGKSLRLSCAASGFTLDDYAMHWVRQAPGKGLEW VSGINWNSEEIGYADSVKGRFTISRDNAKNSLYLQMNSLRTEDTALY YCAKVPGYSHGWIDAEDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 212 | P1-070876 P1-068761_E30D_E32Y LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 213 | P1-070878 P1-068761_E55A_E56N VH | EVQLVESGGGLVQPGKSLRLSCAASGFTLEDEAMHWVRQAPGKGLEW VSGINWNSANIGYADSVKGRETISRDNAKNSLYLQMNSLRTEDTALY YCAKVPGYSHGWIDAEDVWGQGTMVTVSS |
| 214 | P1-070878 P1-068761_E55A_E56N VL | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 215 | P1-070878 P1-068761_E55A_E56N IgG1.3 HC | EVQLVESGGGLVQPGKSLRLSCAASGFTLEDEAMHWVRQAPGKGLEW VSGINWNSANIGYADSVKGRFTISRDNAKNSLYLQMNSLRTEDTALY YCAKVPGYSHGWIDAEDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 216 | P1-070878 P1-068761_E55A_E56N LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 217 | P1-070880 P1-068761_H100G_E100 fF VH | EVQLVESGGGLVQPGKSLRLSCAASGFTLEDEAMHWVRQAPGKGLEW VSGINWNSEEIGYADSVKGRFTISRDNAKNSLYLQMNSLRTEDTALY YCAKVPGYSGGWIDAFDVWGQGTMVTVSS |
| 218 | P1-070880 P1-068761_H100G_E100 fF VL | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 219 | P1-070880 P1-068761_H100G_E100 fF IgG1.3 HC | EVQLVESGGGLVQPGKSLRLSCAASGFTLEDEAMHWVRQAPGKGLEW VSGINWNSEEIGYADSVKGRFTISRDNAKNSLYLQMNSLRTEDTALY YCAKVPGYSGGWIDAFDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 220 | P1-070880 P1-068761_H100G_E100 fF LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 221 | P1-070882 P1-068761_E32Y_E55A VH | EVQLVESGGGLVQPGKSLRLSCAASGFTLEDYAMHWVRQAPGKGLEW VSGINWNSAEIGYADSVKGRFTISRDNAKNSLYLQMNSLRTEDTALY YCAKVPGYSHGWIDAEDVWGQGTMVTVSS |
| 222 | P1-070882 P1-068761_E32Y_E55A VL | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |

-continued

| SEQ ID NO | Name | Sequence |
|---|---|---|
| 223 | P1-070882 P1-068761_E32Y_E55A IgG1.3 HC | EVQLVESGGGLVQPGKSLRLSCAASGFTLEDYAMHWVRQAPGKGLEW VSGINWNSAEIGYADSVKGRFTISRDNAKNSLYLQMNSLRTEDTALY YCAKVPGYSHGWIDAEDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 224 | P1-070882 P1-068761_E32Y_E55A LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 225 | P1-070884 P1-068761_E32Y_E56N VH | EVQLVESGGGLVQPGKSLRLSCAASGFTLEDYAMHWVRQAPGKGLEW VSGINWNSENIGYADSVKGRFTISRDNAKNSLYLQMNSLRTEDTALY YCAKVPGYSHGWIDAEDVWGQGTMVTVSS |
| 226 | P1-070884 P1-068761_E32Y_E56N VL | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 227 | P1-070884 P1-068761_E32Y_E56N IgG1.3 HC | EVQLVESGGGLVQPGKSLRLSCAASGFTLEDYAMHWVRQAPGKGLEW VSGINWNSENIGYADSVKGRFTISRDNAKNSLYLQMNSLRTEDTALY YCAKVPGYSHGWIDAEDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 228 | P1-070884 P1-068761_E32Y_E56N LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 229 | P1-070886 P1-068761_E32Y_H100G VH | EVQLVESGGGLVQPGKSLRLSCAASGFTLEDYAMHWVRQAPGKGLEW VSGINWNSEEIGYADSVKGRFTISRDNAKNSLYLQMNSLRTEDTALY YCAKVPGYSGGWIDAEDVWGQGTMVTVSS |
| 230 | P1-070886 P1-068761_E32Y_H100G VL | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 231 | P1-070886 P1-068761_E32Y_H100G IgG1.3 HC | EVQLVESGGGLVQPGKSLRLSCAASGFTLEDYAMHWVRQAPGKGLEW VSGINWNSEEIGYADSVKGRFTISRDNAKNSLYLQMNSLRTEDTALY YCAKVPGYSGGWIDAEDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 232 | P1-070886 P1-068761_E32Y_H100G LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTEGPGTKVDIKRTVAAPSVFIFPPSDEQLKSGTASVVCLLNNEY PREAKVQWKVDNALQSGNSQESVTEQDSKDSTYSLSSTLTLSKADYE KHKVYACEVTHQGLSSPVTKSFNRGEC |
| 233 | P1-070888 P1-068761_E32Y_E100f F VH | EVQLVESGGGLVQPGKSLRLSCAASGFTLEDYAMHWVRQAPGKGLEW VSGINWNSEEIGYADSVKGRFTISRDNAKNSLYLQMNSLRTEDTALY YCAKVPGYSHGWIDAFDVWGQGTMVTVSS |
| 234 | P1-070888 P1-068761_E32Y_E100f F VL | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |

| SEQ ID NO | Name | Sequence |
|---|---|---|
| 235 | P1-070888 P1-068761_E32Y_E100fF IgG1.3 HC | EVQLVESGGGLVQPGKSLRLSCAASGFTLEDYAMHWVRQAPGKGLEW VSGINWNSEEIGYADSVKGRFTISRDNAKNSLYLQMNSLRTEDTALY YCAKVPGYSHGWIDAFDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 236 | P1-070888 P1-068761_E32Y_E100fF LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTEGPGTKVDIKRTVAAPSVFIFPPSDEQLKSGTASVVCLLNNEY PREAKVQWKVDNALQSGNSQESVTEQDSKDSTYSLSSTLTLSKADYE KHKVYACEVTHQGLSSPVTKSFNRGEC |
| 237 | P1-070890 P1-068761_E30D_E55A VH | EVQLVESGGGLVQPGKSLRLSCAASGFTLDDEAMHWVRQAPGKGLEW VSGINWNSAEIGYADSVKGRFTISRDNAKNSLYLQMNSLRTEDTALY YCAKVPGYSHGWIDAEDVWGQGTMVTVSS |
| 238 | P1-070890 P1-068761_E30D_E55A VL | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 239 | P1-070890 P1-068761_E30D_E55A IgG1.3 HC | EVQLVESGGGLVQPGKSLRLSCAASGFTLDDEAMHWVRQAPGKGLEW VSGINWNSAEIGYADSVKGRFTISRDNAKNSLYLQMNSLRTEDTALY YCAKVPGYSHGWIDAEDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 240 | P1-070890 P1-068761_E30D_E55A LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTEGPGTKVDIKRTVAAPSVFIFPPSDEQLKSGTASVVCLLNNEY PREAKVQWKVDNALQSGNSQESVTEQDSKDSTYSLSSTLTLSKADYE KHKVYACEVTHQGLSSPVTKSFNRGEC |
| 241 | P1-070892 P1-068761_E30D_E56N VH | EVQLVESGGGLVQPGKSLRLSCAASGFTLDDEAMHWVRQAPGKGLEW VSGINWNSENIGYADSVKGRFTISRDNAKNSLYLQMNSLRTEDTALY YCAKVPGYSHGWIDAEDVWGQGTMVTVSS |
| 242 | P1-070892 P1-068761_E30D_E56N VL | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 243 | P1-070892 P1-068761_E30D_E56N IgG1.3 HC | EVQLVESGGGLVQPGKSLRLSCAASGFTLDDEAMHWVRQAPGKGLEW VSGINWNSENIGYADSVKGRFTISRDNAKNSLYLQMNSLRTEDTALY YCAKVPGYSHGWIDAEDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 244 | P1-070892 P1-068761_E30D_E56N LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTEGPGTKVDIKRTVAAPSVFIFPPSDEQLKSGTASVVCLLNNEY PREAKVQWKVDNALQSGNSQESVTEQDSKDSTYSLSSTLTLSKADYE KHKVYACEVTHQGLSSPVTKSFNRGEC |
| 245 | P1-070894 P1-068761_E30D_H100G VH | EVQLVESGGGLVQPGKSLRLSCAASGFTLDDEAMHWVRQAPGKGLEW VSGINWNSEEIGYADSVKGRFTISRDNAKNSLYLQMNSLRTEDTALY YCAKVPGYSGGWIDAEDVWGQGTMVTVSS |
| 246 | P1-070894 P1-068761_E30D_H100G VL | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 247 | P1-070894 P1-068761_3E30D_H100G IgG1.3 HC | EVQLVESGGGLVQPGKSLRLSCAASGFTLDDEAMHWVRQAPGKGLEW VSGINWNSEEIGYADSVKGRFTISRDNAKNSLYLQMNSLRTEDTALY YCAKVPGYSGGWIDAEDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV |

| SEQ ID NO | Name | Sequence |
|---|---|---|
| | | SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 248 | P1-070894 P1-068761_E30D_H100G LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 249 | P1-070896 P1-068761_E30D_E100f VH | EVQLVESGGGLVQPGKSLRLSCAASGFTLDDEAMHWVRQAPGKGLEW VSGINWNSEEIGYADSVKGRFTISRDNAKNSLYLQMNSLRTEDTALY YCAKVPGYSHGWIDAFDVWGQGTMVTVSS |
| 250 | P1-070896 P1-068761_E30D_E100f VL | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 251 | P1-070896 P1-068761_E30D_E100f IgG1.3 HC | EVQLVESGGGLVQPGKSLRLSCAASGFTLDDEAMHWVRQAPGKGLEW VSGINWNSEEIGYADSVKGRFTISRDNAKNSLYLQMNSLRTEDTALY YCAKVPGYSHGWIDAFDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 252 | P1-070896 P1-068761_E30D_E100f LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 253 | P1-070898 P1-068761_E55A_E100f VH | EVQLVESGGGLVQPGKSLRLSCAASGFTLEDEAMHWVRQAPGKGLEW VSGINWNSAEIGYADSVKGRFTISRDNAKNSLYLQMNSLRTEDTALY YCAKVPGYSHGWIDAFDVWGQGTMVTVSS |
| 254 | P1-070898 P1-068761_E55A_E100f VL | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 255 | P1-070898 P1 068761_E55A_E100f IgG1.3 HC | EVQLVESGGGLVQPGKSLRLSCAASGFTLEDEAMHWVRQAPGKGLEW VSGINWNSAEIGYADSVKGRFTISRDNAKNSLYLQMNSLRTEDTALY YCAKVPGYSHGWIDAFDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 256 | P1-070898 P1-068761_E55A_E100f LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTEGPGTKVDIKRTVAAPSVFIFPPSDEQLKSGTASVVCLLNNEY PREAKVQWKVDNALQSGNSQESVTEQDSKDSTYSLSSTLTLSKADYE KHKVYACEVTHQGLSSPVTKSFNRGEC |
| 257 | P1-070900 P1-068761_E56N_H100G VH | EVQLVESGGGLVQPGKSLRLSCAASGFTLEDEAMHWVRQAPGKGLEW VSGINWNSENIGYADSVKGRFTISRDNAKNSLYLQMNSLRTEDTALY YCAKVPGYSGGWIDAEDVWGQGTMVTVSS |
| 258 | P1-070900 P1-068761_E56N_H100G VL | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 259 | P1-070900 P1-068761_E56N_H100G IgG1.3 HC | EVQLVESGGGLVQPGKSLRLSCAASGFTLEDEAMHWVRQAPGKGLEW VSGINWNSENIGYADSVKGRFTISRDNAKNSLYLQMNSLRTEDTALY YCAKVPGYSGGWIDAEDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |

| SEQ ID NO | Name | Sequence |
|---|---|---|
| 260 | P1-070900 P1-068761_E56N_H100G LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTEGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 261 | P1-070902 P1-068761_E56N_E100fF VH | EVQLVESGGGLVQPGKSLRLSCAASGFTLEDEAMHWVRQAPGKGLEW VSGINWNSENIGYADSVKGRFTISRDNAKNSLYLQMNSLRTEDTALY YCAKVPGYSHGWIDAFDVWGQGTMVTVSS |
| 262 | P1-070902 P1-068761_E56N_E100fF VL | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 263 | P1-070902 P1-068761_E56N_E100fF IgG1.3 HC | EVQLVESGGGLVQPGKSLRLSCAASGFTLEDEAMHWVRQAPGKGLEW VSGINWNSENIGYADSVKGRFTISRDNAKNSLYLQMNSLRTEDTALY YCAKVPGYSHGWIDAFDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 264 | P1-070902 P1-068761_E56N_E100fF LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 265 | P1-070904 P1-068767_E30D VH | EVQLVESGGGLVQPGKSLRLSCAASGFTLDDYAMHWVRQAPGKGLEW VSGIDWNSENIGYADSVKGRFTISRDNAKNSLYLQMNSLRTEDTALY YCAKVPGYSGGWIDAEDDWGQGTMVTVSS |
| 266 | P1-070904 P1-068767_E30D VL | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 267 | P1-070904 P1-068767_E30D IgG1.3 HC | EVQLVESGGGLVQPGKSLRLSCAASGFTLDDYAMHWVRQAPGKGLEW VSGIDWNSENIGYADSVKGRFTISRDNAKNSLYLQMNSLRTEDTALY YCAKVPGYSGGWIDAEDDWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 268 | P1-070904 P1-068767_E30D LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 269 | P1-070906 P1-068767_D52N VH | EVQLVESGGGLVQPGKSLRLSCAASGFTLEDYAMHWVRQAPGKGLEW VSGINWNSENIGYADSVKGRFTISRDNAKNSLYLQMNSLRTEDTALY YCAKVPGYSGGWIDAEDDWGQGTMVTVSS |
| 270 | P1-070906 P1-068767_D52N VL | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 271 | P1-070906 P1-068767_D52N IgG1.3 HC | EVQLVESGGGLVQPGKSLRLSCAASGFTLEDYAMHWVRQAPGKGLEW VSGINWNSENIGYADSVKGRFTISRDNAKNSLYLQMNSLRTEDTALY YCAKVPGYSGGWIDAEDDWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 272 | P1-070906 P1-068767_D52N LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTEGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 273 | P1-070908 P1-068767_E55A VH | EVQLVESGGGLVQPGKSLRLSCAASGFTLEDYAMHWVRQAPGKGLEW VSGIDWNSANIGYADSVKGRFTISRDNAKNSLYLQMNSLRTEDTALY YCAKVPGYSGGWIDAEDDWGQGTMVTVSS |

| SEQ ID NO | Name | Sequence |
|---|---|---|
| 274 | P1-070908 P1-068767_E55A VL | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 275 | P1-070908 P1-068767_E55A IgG1.3 HC | EVQLVESGGGLVQPGKSLRLSCAASGFTLEDYAMHWVRQAPGKGLEW VSGIDWNSENIGYADSVKGRFTISRDNAKNSLYLQMNSLRTEDTALY YCAKVPGYSGGWIDAEDDWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 276 | P1-070908 P1-068767_E55A LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTEGPGTKVDIKRTVAAPSVFIFPPSDEQLKSGTASVVCLLNNEY PREAKVQWKVDNALQSGNSQESVTEQDSKDSTYSLSSTLTLSKADYE KHKVYACEVTHQGLSSPVTKSFNRGEC |
| 277 | P1-070910 P1-068767_E100fF VH | EVQLVESGGGLVQPGKSLRLSCAASGFTLEDYAMHWVRQAPGKGLEW VSGIDWNSENIGYADSVKGRFTISRDNAKNSLYLQMNSLRTEDTALY YCAKVPGYSGGWIDAFDDWGQGTMVTVSS |
| 278 | P1-070910 P1-068767_E100fF VL | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 279 | P1-070910 P1-068767_E100fF IgG1.3 HC | EVQLVESGGGLVQPGKSLRLSCAASGFTLEDYAMHWVRQAPGKGLEW VSGIDWNSENIGYADSVKGRFTISRDNAKNSLYLQMNSLRTEDTALY YCAKVPGYSGGWIDAFDDWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 280 | P1-070910 P1-068767_E100fF LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTEGPGTKVDIKRTVAAPSVFIFPPSDEQLKSGTASVVCLLNNEY PREAKVQWKVDNALQSGNSQESVTEQDSKDSTYSLSSTLTLSKADYE KHKVYACEVTHQGLSSPVTKSFNRGEC |
| 281 | P1-070912 P1-068767_D102V VH | EVQLVESGGGLVQPGKSLRLSCAASGFTLEDYAMHWVRQAPGKGLEW VSGIDWNSENIGYADSVKGRFTISRDNAKNSLYLQMNSLRTEDTALY YCAKVPGYSGGWIDAEDVWGQGTMVTVSS |
| 282 | P1-070912 P1-068767_D102V VL | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 283 | P1-070912 P1-068767_D102V IgG1.3 HC | EVQLVESGGGLVQPGKSLRLSCAASGFTLEDYAMHWVRQAPGKGLEW VSGIDWNSENIGYADSVKGRFTISRDNAKNSLYLQMNSLRTEDTALY YCAKVPGYSGGWIDAEDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 284 | P1-070912 P1-068767_D102V LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 285 | P1-070914 P1-068767_E30D_D52N VH | EVQLVESGGGLVQPGKSLRLSCAASGFTLDDYAMHWVRQAPGKGLEW VSGINWNSENIGYADSVKGRFTISRDNAKNSLYLQMNSLRTEDTALY YCAKVPGYSGGWIDAEDDWGQGTMVTVSS |
| 286 | P1-070914 P1-068767_E30D_D52N VL | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 287 | P1-070914 P1-068767_E30D_D52N IgG1.3 HC | EVQLVESGGGLVQPGKSLRLSCAASGFTLDDYAMHWVRQAPGKGLEW VSGINWNSENIGYADSVKGRFTISRDNAKNSLYLQMNSLRTEDTALY YCAKVPGYSGGWIDAEDDWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK |

| SEQ ID NO | Name | Sequence |
|---|---|---|
| | | GFYPSDIAVEWESNGQPENNYKTTPPVLDSDGSFFLYSKLTVDKSRW QQGNVFSCSVMHEALHNHYTQKSLSLSPG |
| 288 | P1-070914 P1-068767_E30D_D52N LC | EIVLTQSPGTLSLPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 289 | P1-070916 P1-068767_D52N_E55A VH | EVQLVESGGGLVQPGKSLRLSCAASGFTLEDYAMHWVRQAPGKGLEW VSGINWNSANIGYADSVKGRFTISRDNAKNSLYLQMNSLRTEDTALY YCAKVPGYSGGWIDAEDDWGQGTMVTVSS |
| 290 | P1-070916 P1-068767_D52N_E55A VL | EIVLTQSPGTLSLPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 291 | P1-070916 P1-068767_D52N_E55A IgG1.3 HC | EVQLVESGGGLVQPGKSLRLSCAASGFTLEDYAMHWVRQAPGKGLEW VSGINWNSANIGYADSVKGRFTISRDNAKNSLYLQMNSLRTEDTALY YCAKVPGYSGGWIDAEDDWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 292 | P1-070916 P1-068767_D52N_E55A LC | EIVLTQSPGTLSLPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 293 | P1-070918 P1-068767_E55A_E100f F VH | EVQLVESGGGLVQPGKSLRLSCAASGFTLEDYAMHWVRQAPGKGLEW VSGIDWNSANIGYADSVKGRFTISRDNAKNSLYLQMNSLRTEDTALY YCAKVPGYSGGWIDAFDDWGQGTMVTVSS |
| 294 | P1-070918 P1-068767_E55A_E100f F VL | EIVLTQSPGTLSLPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 295 | P1-070918 P1-068767_E55A_E100f F IgG1.3 HC | EVQLVESGGGLVQPGKSLRLSCAASGFTLEDYAMHWVRQAPGKGLEW VSGIDWNSANIGYADSVKGRFTISRDNAKNSLYLQMNSLRTEDTALY YCAKVPGYSGGWIDAFDDWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 296 | P1-070918 P1-068767_E55A_E100f F LC | EIVLTQSPGTLSLPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 297 | P1-070920 P1-068767_E100fF_D10 2V VH | EVQLVESGGGLVQPGKSLRLSCAASGFTLEDYAMHWVRQAPGKGLEW VSGIDWNSENIGYADSVKGRFTISRDNAKNSLYLQMNSLRTEDTALY YCAKVPGYSGGWIDAFDVWGQGTMVTVSS |
| 298 | P1-070920 P1-068767_E100fF_D10 2V VL | EIVLTQSPGTLSLPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 299 | P1-070920 P1-068767_E100fF_D10 2V IgG1.3 HC | EVQLVESGGGLVQPGKSLRLSCAASGFTLEDYAMHWVRQAPGKGLEW VSGIDWNSENIGYADSVKGRFTISRDNAKNSLYLQMNSLRTEDTALY YCAKVPGYSGGWIDAFDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |

| SEQ ID NO | Name | Sequence |
|---|---|---|
| 300 | P1-070920 P1-068767_E100fF_D102V LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 301 | P1-070922 P1-068767_E30D_E55A VH | EVQLVESGGGLVQPGKSLRLSCAASGFTLDDYAMHWVRQAPGKGLEW VSGIDWNSANIGYADSVKGRFTISRDNAKNSLYLQMNSLRTEDTALY YCAKVPGYSGGWIDAEDDWGQGTMVTVSS |
| 302 | P1-070922 P1-068767_E30D_E55A VL | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 303 | P1-070922 P1-068767_E30D_E55A IgG1.3 HC | EVQLVESGGGLVQPGKSLRLSCAASGFTLDDYAMHWVRQAPGKGLEW VSGIDWNSANIGYADSVKGRFTISRDNAKNSLYLQMNSLRTEDTALY YCAKVPGYSGGWIDAEDDWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 304 | P1-070922 P1-068767_E30D_E55A LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 305 | P1-070924 P1-068767_E30D_E100fF VH | EVQLVESGGGLVQPGKSLRLSCAASGFTLDDYAMHWVRQAPGKGLEW VSGIDWNSENIGYADSVKGRFTISRDNAKNSLYLQMNSLRTEDTALY YCAKVPGYSGGWIDAFDDWGQGTMVTVSS |
| 306 | P1-070924 P1-068767_E30D_E100fF VL | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 307 | P1-070924 P1-068767_E30D_E100fF IgG1.3 HC | EVQLVESGGGLVQPGKSLRLSCAASGFTLDDYAMHWVRQAPGKGLEW VSGIDWNSENIGYADSVKGRFTISRDNAKNSLYLQMNSLRTEDTALY YCAKVPGYSGGWIDAFDDWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 308 | P1-070924 P1-068767_E30D_E100fF LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTEGPGTKVDIKRTVAAPSVFIFPPSDEQLKSGTASVVCLLNNEY PREAKVQWKVDNALQSGNSQESVTEQDSKDSTYSLSSTLTLSKADYE KHKVYACEVTHQGLSSPVTKSFNRGEC |
| 309 | P1-070926 P1-068767_E30D_D102V VH | EVQLVESGGGLVQPGKSLRLSCAASGFTLDDYAMHWVRQAPGKGLEW VSGIDWNSENIGYADSVKGRFTISRDNAKNSLYLQMNSLRTEDTALY YCAKVPGYSGGWIDAEDVWGQGTMVTVSS |
| 310 | P1-070926 P1-068767_E30D_D102V VL | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 311 | P1-070926 P1-068767_E30D_D102V IgG1.3 HC | EVQLVESGGGLVQPGKSLRLSCAASGFTLDDYAMHWVRQAPGKGLEW VSGIDWNSENIGYADSVKGRFTISRDNAKNSLYLQMNSLRTEDTALY YCAKVPGYSGGWIDAEDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 312 | P1-070926 P1-068767_E30D_D102V LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTEGPGTKVDIKRTVAAPSVFIFPPSDEQLKSGTASVVCLLNNEY PREAKVQWKVDNALQSGNSQESVTEQDSKDSTYSLSSTLTLSKADYE KHKVYACEVTHQGLSSPVTKSFNRGEC |

| SEQ ID NO | Name | Sequence |
|---|---|---|
| 313 | P1-070928 P1-068767_D52N_E100f VH | EVQLVESGGGLVQPGKSLRLSCAASGFTLEDYAMHWVRQAPGKGLEW VSGINWNSENIGYADSVKGRFTISRDNAKNSLYLQMNSLRTEDTALY YCAKVPGYSGGWIDAFDDWGQGTMVTVSS |
| 314 | P1-070928 P1-068767_D52N_E100f VL | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 315 | P1-070928 P1-068767_D52N_E100f IgG1.3 HC | EVQLVESGGGLVQPGKSLRLSCAASGFTLEDYAMHWVRQAPGKGLEW VSGINWNSENIGYADSVKGRFTISRDNAKNSLYLQMNSLRTEDTALY YCAKVPGYSGGWIDAFDDWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 316 | P1-070928 P1-068767_D52N_E100f LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNEY PREAKVQWKVDNALQSGNSQESVTEQDSKDSTYSLSSTLTLSKADYE KHKVYACEVTHQGLSSPVTKSFNRGEC |
| 317 | P1-070930 P1-068767_D52N_D102V VH | EVQLVESGGGLVQPGKSLRLSCAASGFTLEDYAMHWVRQAPGKGLEW VSGINWNSENIGYADSVKGRFTISRDNAKNSLYLQMNSLRTEDTALY YCAKVPGYSGGWIDAEDVWGQGTMVTVSS |
| 318 | P1-070930 P1-068767_D52N_D102V VL | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 319 | P1-070930 P1-068767_D52N_D102V IgG1.3 HC | EVQLVESGGGLVQPGKSLRLSCAASGFTLEDYAMHWVRQAPGKGLEW VSGINWNSENIGYADSVKGRFTISRDNAKNSLYLQMNSLRTEDTALY YCAKVPGYSGGWIDAEDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 320 | P1-070930 P1-068767_D52N_D102V LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNEY PREAKVQWKVDNALQSGNSQESVTEQDSKDSTYSLSSTLTLSKADYE KHKVYACEVTHQGLSSPVTKSFNRGEC |
| 321 | P1-070932 P1-068767_E55A_D102V VH | EVQLVESGGGLVQPGKSLRLSCAASGFTLEDYAMHWVRQAPGKGLEW VSGIDWNSANIGYADSVKGRFTISRDNAKNSLYLQMNSLRTEDTALY YCAKVPGYSGGWIDAEDVWGQGTMVTVSS |
| 322 | P1-070932 P1-068767_E55A_D102V VL | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 323 | P1-070932 P1-068767_E55A_D102V IgG1.3 HC | EVQLVESGGGLVQPGKSLRLSCAASGFTLEDYAMHWVRQAPGKGLEW VSGIDWNSANIGYADSVKGRFTISRDNAKNSLYLQMNSLRTEDTALY YCAKVPGYSGGWIDAEDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 324 | P1-070932 P1-068767_E55A_D102V LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNEY PREAKVQWKVDNALQSGNSQESVTEQDSKDSTYSLSSTLTLSKADYE KHKVYACEVTHQGLSSPVTKSFNRGEC |
| 325 | hVISTA-ECD 6-His tag | KGHDVTFYKT WYRSSRGEVQ TCSERRPIRN LTFQDLHLHH GGHQAANTSH DLAQRHGLES ASDHHGNFSI TMRNLTLLDS GLYCCLVVEI RHHHSEHRVH GAMELQVQTG KDAPSNCVVY PSSSQESENI TAHHHHHHHH |

-continued

| SEQ ID NO | Name | Sequence |
|---|---|---|
| 326 | Cyno VISTA-ECD 6-His tag | AFKVATLYSL YVCPEGQNVT LTCRVFGPVD KGHDVTFYKT WYRSSRGEVQ TCSERRPIRN LTFQDLHLHH GGHQAANTSH DLAQRHGLES ASDHHGNFSI TMRNLTLLDS GLYCCLVVEI RHHHSEHRVH GAMELQVQTG KDAPSSCVAY PSSSQESENI TAHHHHHHHH |
| 327 | P1-069059 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGAAGATT ATGCCATGCACTGGGTCCGGCAAGCTCCAGGGAAGGGCCTGGAGTGG GTCTCAGGTATTAATTGGAACAGTGACCATATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCGGTGGCTGGATTGACGCTGA AGATGACTGGGGCCAAGGGACAATGGTCACCGTCTCTTCA |
| 328 | P1-069059 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 329 | P1-069061 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGAAGATT ATGCCATGCACTGGGTCCGGCAAGCTCCAGGGAAGGGCCTGGAGTGG GTCTCAGGTATTAATTGGAACAGTGCTGAAATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCGGTGGCTGGATTGACGCTGA AGATGACTGGGGCCAAGGGACAATGGTCACCGTCTCTTCA |
| 330 | P1-069061 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 331 | P1-069063 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGAAGATT ATGCCATGCACTGGGTCCGGCAAGCTCCAGGGAAGGGCCTGGAGTGG GTCTCAGGTATTAATTGGAACAGTGCTGAAATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCGGTGGCTGGATTGACGCTGA CGATGAATGGGCCAAGGGACAATGGTCACCGTCTCTTCA |
| 332 | P1-069063 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 333 | P1-069065 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGAAGATG AAGCCATGCACTGGGTCCGGCAAGCTCCAGGGAAGGGCCTGGAGTGG GTCTCAGGTATTAATTGGAACAGTGACGACATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCGGTGGCTGGATTGACGCTTT TGATGTCTGGGGCCAAGGGACAATGGTCACCGTCTCTTCA |
| 334 | P1-069065 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 335 | P1-069067 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGATGATT ATGCCATGCACTGGGTCCGGCAAGCTCCAGGGAAGGGCCTGGAGTGG GTCTCAGGTATTAATTGGAACAGTGAAGAAATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCGGTGGCTGGATTGACGCTGA CGATGAATGGGCCAAGGGACAATGGTCACCGTCTCTTCA |
| 336 | P1-069067 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC |

| SEQ ID NO | Name | Sequence |
|---|---|---|
| | | CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 337 | P1-069069 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGATGATT ATGCCATGCACTGGGTCCGGCAAGCTCCAGGGAAGGGCCTGGAGTGG GTCTCAGGTATTAATTGGAACAGTGAAGAAATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCGGTGGCTGGATTGACGCTGA CGATGTCTGGGGCCAAGGGACAATGGTCACCGTCTCTTCA |
| 338 | P1-069069 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 339 | P1-069071 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGAAGATG AAGCCATGCACTGGGTCCGGCAAGCTCCAGGGAAGGGCCTGGAGTGG GTCTCAGGTATTAATTGGAACAGTGCTGACATAGGCTATGCGGACTC TGTGAAGGGCCGATTCACCATCTCCAGAGACAACGCCAAGAAC CCC TGTATCTGCAAATGAACAGTCTGAGAACTGAGGACACGGCCTTGTAT TACTGTGCAAAAGTTCCTGGGTATAGCGAAGGCTGGATTGACGCTTT TGATGTCTGGGGCCAAGGGACAATGGTCACCGTCTCTTCA |
| 340 | P1-069071 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 341 | P1-069073 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGAAGATG AAGCCATGCACTGGGTCCGGCAAGCTCCAGGGAAGGGCCTGGAGTGG GTCTCAGGTATTAATTGGAACAGTGCTGAAATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCGGTGGCTGGATTGACGCTGA AGATGTCTGGGGCCAAGGGACAATGGTCACCGTCTCTTCA |
| 342 | P1-069073 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 343 | P1-069075 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGAAGATT ATGCCATGCACTGGGTCCGGCAAGCTCCAGGGAAGGGCCTGGAGTGG GTCTCAGGTATTAATTGGGACAGTGCTGAAATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCCATGGCTGGATTGACGCTGA AGATGTCTGGGGCCAAGGGACAATGGTCACCGTCTCTTCA |
| 344 | P1-069075 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 345 | P1-069077 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGAAGATG AAGCCATGCACTGGGTCCGGCAAGCTCCAGGGAAGGGCCTGGAGTGG GTCTCAGGTATTAATTGGAACAGTGACGAAATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCGGTGGCTGGATTGACGCTTT TGATGTCTGGGGCCAAGGGACAATGGTCACCGTCTCTTCA |
| 346 | P1-069077 VL DNA | GAAATTGTGTTGACGCAGTCTCCAGGCACCCTGTCTTTGTCT CAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT |

| SEQ ID NO | Name | Sequence |
|---|---|---|
| | | CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAA |
| 347 | P1-068761 VH DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGAGGATG<br>AGGCCATGCACTGGGTCCGGCAAGCTCCAGGGAAGGGCCTGGAGTGG<br>GTCTCAGGTATTAATTGGAACAGTGAAGAGATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCCATGGCTGGATTGACGCTGA<br>AGATGTCTGGGGCCAAGGGACAATGGTCACCGTCTCTTCA |
| 348 | P1-068761 VL DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAA |
| 349 | P1-068767 VH DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGAGGATT<br>ATGCCATGCACTGGGTCCGGCAAGCTCCAGGGAAGGGCCTGGAGTGG<br>GTCTCAGGTATTGATTGGAACAGTGAAAACATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCGGTGGCTGGATTGACGCTGA<br>AGATGACTGGGGCCAAGGGACAATGGTCACCGTCTCTTCA |
| 350 | P1-068767 VL DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAA |
| 351 | P1-068773 VH DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGAGGATT<br>ATGCCATGCACTGGGTCCGGCAAGCTCCAGGGAAGGGCCTGGAGTGG<br>GTCTCAGGTATTGATTGGAACAGTGATAACATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCGGTGGCTGGATTGACGCTGA<br>AGATGACTGGGGCCAAGGGACAATGGTCACCGTCTCTTCA |
| 352 | P1-068773 VL DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAA |
| 353 | P1-068765 VH DNA | GAGGTGCAGCTGGTGGAGTCTGGGGGAGGCTTGGTACAGCCTGGCAA<br>GTCCCTGAGACTCTCCTGTGCAGCCTCTGGATTCACCGATGAGGATT<br>ATGCCATGCACTGGGTCCGGCAAGCTCCAGGGAAGGGCCTGGAGTGG<br>GTCTCAGGTATTAATTGGAACAGTGAAGAGATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCGGTGGCTGGATTGACGCTGA<br>AGATGACTGGGGCCAAGGGACAATGGTCACCGTCTCTTCA |
| 354 | P1-068765 VL DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAA |
| 355 | P1-061029 VH DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGATGATT<br>ATGCCATGCACTGGGTCCGGCAAGCTCCAGGGAAGGGCCTGGAGTGG<br>GTCTCAGGTATTAATTGGAACAGTGCTAACATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCGGTGGCTGGATTGACGCTTT<br>TGATGTCTGGGGCCAAGGGACAATGGTCACCGTCTCTTCA |
| 356 | P1-061029 VL DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC |

| SEQ ID NO | Name | Sequence |
|---|---|---|
| | | TGGAGCCTGAAGATTTTGCAGTGTATTACTGTCAGCAGTATGGTAGC<br>TCACCATTCACTTTCGGCCCTGGGACCAAAGTGGATATCAAA |
| 357 | P1-068757 VH DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGAGGATG<br>AGGCCATGCACTGGGTCCGGCAAGCTCCAGGGAAGGGCCTGGAGTGG<br>GTCTCAGGTATTAATTGGAACAGTGAAGATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCGGTGGCTGGATTGACGCTGA<br>AGATGACTGGGGCCAAGGGACAATGGTCACCGTCTCTTCA |
| 358 | P1-068757 VL DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAA |
| 359 | P1-068771 VH DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGAGGATG<br>AGGCCATGCACTGGGTCCGGCAAGCTCCAGGGAAGGGCCTGGAGTGG<br>GTCTCAGGTATTAATTGGAACAGTCATGAGATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCGGTGGCTGGATTGACGCTGA<br>AGATGACTGGGGCCAAGGGACAATGGTCACCGTCTCTTCA |
| 360 | P1-068771 VL DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAA |
| 361 | P1-068775 VH DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGAGGATG<br>AGGCCATGCACTGGGTCCGGCAAGCTCCAGGGAAGGGCCTGGAGTGG<br>GTCTCAGGTATTGATTGGAACAGTGAAGAGATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCCATGGCTGGATTGACGCTGA<br>AGATGACTGGGGCCAAGGGACAATGGTCACCGTCTCTTCA |
| 362 | P1-068775 VL DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAA |
| 363 | P1-068769 VH DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGAGGATG<br>AGGCCATGCACTGGGTCCGGCAAGCTCCAGGGAAGGGCCTGGAGTGG<br>GTCTCAGGTATTAATTGGAACAGTGATCACATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCGGTGGCTGGATTGACGCTGA<br>AGATGACTGGGGCCAAGGGACAATGGTCACCGTCTCTTCA |
| 364 | P1-068769 VL DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAA |
| 365 | P1-068759 VH DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGAGGATG<br>AGGCCATGCACTGGGTCCGGCAAGCTCCAGGGAAGGGCCTGGAGTGG<br>GTCTCAGGTATTGATTGGAACAGTGAAAACATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCGGTGGCTGGATTGACGCTGA<br>AGATGACTGGGGCCAAGGGACAATGGTCACCGTCTCTTCA |
| 366 | P1-068759 VL DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC |

| SEQ ID NO | Name | Sequence |
|---|---|---|
| | | TGGAGCCTGAAGATTTTGCAGTGTATTACTGTCAGCAGTATGGTAGC<br>TCACCATTCACTTTCGGCCCTGGGACCAAAGTGGATATCAAA |
| 367 | P1-068763 VH DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGAGGATT<br>ATGCCATGCACTGGGTCCGGCAAGCTCCAGGGAAGGGCCTGGAGTGG<br>GTCTCAGGTATTGATTGGAACAGTGAAAACATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCCATGGCTGGATTGACGCTGA<br>AGATGTCTGGGGCCAAGGGACAATGGTCACCGTCTCTTCA |
| 368 | P1-068763 VL DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAA |
| 369 | P1-061015 VH DNA | CAGGTGCAGCTGGTGGAGTCTGGGGGAGGCGTGGTCCAGCCTGGGAG<br>GTCCCTGAGACTCTCCTGTGCAGCGTCTGGATTCACCTTCAGTAGCT<br>ATGCCATGCACTGGGTCCGCCAGGCTCCAGGCAAGGGGCTGGAGTGG<br>GTGGCAATTATATGGTATGATGGAAGTAATAAATACTATGCAGACTC<br>CGTGAAGGGCCGATTCACCATCTCCAGAGACAATTCCAAGAACACGC<br>TGTATCTGCAAATGAACAGCCTGAGAGCCGAGGACACGGCTGTGTAT<br>TACTGTGCGAGAGATAGTGGTTTTTACTCCTCGTACTACTTTGACTA<br>CTGGGGCCAGGGAACCCTGGTCACCGTCTCCTCA |
| 370 | P1-061015 VL DNA | GAAATTGTGTTGACACAGTCTCCAGCCACCCTGTCTTTGTC CCAGG<br>GGAAAGAGCCACCCTCTCCTGCAGGGCCAGTCAGAGTGTTAGCAGCA<br>GCTACTTAGCCTGGTACCAACAGAAACCTGGCCAGGCTCCCAGGCTC<br>CTCATCTATGATGCATCCAACAGGGCCACTGGCATCCCAGCCAGGTT<br>CAGCGGCAGTGGATCTGGGACAGATTTCACTCTCACCATCAGCAGCC<br>TGGAGCCTGAAGATTTTGCAACTTATTACTGCCAACAGTATAATAGT<br>TACCCGTACACTTTTGGCCAGGGGACCAAGCTGGAGATCAAA |
| 371 | P1-068748 VH DNA | CAGGTGCAGCTGGTGGAGTCTGGGGGAGGCGTGGTCCAGCCTGGGAG<br>GTCCCTGAGACTCTCCTGTGCAGCGTCTGGATTCACCTTCAGTCACC<br>ATGCCATGCACTGGGTCCGCCAGGCTCCAGGCAAGGGGCTGGAGTGG<br>GTGGCAATTATATGGTATGATGGAAGTAATGACGACTATGCAGACTC<br>CGTGAAGGGCCGATTCACCATCTCCAGAGACAATTCCAAGAACACGC<br>TGTATCTGCAAATGAACAGCCTGAGAGCCGAGGACACGGCTGTGTAT<br>TACTGTGCGAGAGATAGTGGTTTTTACGACTCGTACTACTTTGACTA<br>CTGGGGCCAGGGAACCCTGGTCACCGTCTCCTCA |
| 372 | P1-068748 VL DNA | GAAATTGTGTTGACACAGTCTCCAGCCACCCTGTCTTTGTC CCAGG<br>GGAAAGAGCCACCCTCTCCTGCAGGGCCAGTCAGAGTGTTAGCAGCA<br>GCTACTTAGCCTGGTACCAACAGAAACCTGGCCAGGCTCCCAGGCTC<br>CTCATCTATGATGCATCCAACAGGGCCACTGGCATCCCAGCCAGGTT<br>CAGCGGCAGTGGATCTGGGACAGATTTCACTCTCACCATCAGCAGCC<br>TGGAGCCTGAAGATTTTGCAACTTATTACTGCCAACAGTATAATAGT<br>TACCCGTACACTTTTGGCCAGGGGACCAAGCTGGAGATCAAA |
| 373 | P1-068744 VH DNA | CAGGTGCAGCTGGTGGAGTCTGGGGGAGGCGTGGTCCAGCCTGGGAG<br>GTCCCTGAGACTCTCCTGTGCAGCGTCTGGATTCACCTTCAGTGAGT<br>ATGCCATGCACTGGGTCCGCCAGGCTCCAGGCAAGGGGCTGGAGTGG<br>GTGGCACATATATGGTATGATGGAAGTAATAAATACGAGGCAGACTC<br>CGTGAAGGGCCGATTCACCATCTCCAGAGACAATTCCAAGAACACGC<br>TGTATCTGCAAATGAACAGCCTGAGAGCCGAGGACACGGCTGTGTAT<br>TACTGTGCGAGAGATAGTGGTTTTTACGAATCGTACTACTTTGACGA<br>GTGGGGCCAGGGAACCCTGGTCACCGTCTCCTCA |
| 374 | P1-068744 VL DNA | GAAATTGTGTTGACACAGTCTCCAGCCACCCTGTCTTTGTCTCCAGG<br>GGAAAGAGCCACCCTCTCCTGCAGGGCCAGTCAGAGTGTTAGCAGCA<br>GCTACTTAGCCTGGTACCAACAGAAACCTGGCCAGGCTCCCAGGCTC<br>CTCATCTATGATGCATCCAACAGGGCCACTGGCATCCCAGCCAGGTT<br>CAGCGGCAGTGGATCTGGGACAGATTTCACTCTCACCATCAGCAGCC<br>TGGAGCCTGAAGATTTTGCAACTTATTACTGCCAACAGTATAATAGT<br>TACCCGTACACTTTTGGCCAGGGGACCAAGCTGGAGATCAAA |
| 375 | P1-068736 VH DNA | CAGGTGCAGCTGGTGGAGTCTGGGGGAGGCGTGGTCCAGCCTGGGAG<br>GTCCCTGAGACTCTCCTGTGCAGCGTCTGGATTCACCTTCAGTGAGT<br>ATGCCATGCACTGGGTCCGCCAGGCTCCAGGCAAGGGGCTGGAGTGG<br>GTGGCAATTGATTGGTATGATGGAAGTAATAAAGACTATGCAGACTC<br>CGTGAAGGGCCGATTCACCATCTCCAGAGACAATTCCAAGAACACGC<br>TGTATCTGCAAATGAACAGCCTGAGAGCCGAGGACACGGCTGTGTAT<br>TACTGTGCGAGAGATAGTGGTTTTTACGACTCGTACTACTTTGACGA<br>CTGGGGCCAGGGAACCCTGGTCACCGTCTCCTCA |
| 376 | P1-068736 VL DNA | GAAATTGTGTTGACACAGTCTCCAGCCACCCTGTCTTTGTCTCCAGG<br>GGAAAGAGCCACCCTCTCCTGCAGGGCCAGTCAGAGTGTTAGCAGCA<br>GCTACTTAGCCTGGTACCAACAGAAACCTGGCCAGGCTCCCAGGCTC<br>CTCATCTATGATGCATCCAACAGGGCCACTGGCATCCCAGCCAGGTT |

| SEQ ID NO | Name | Sequence |
|---|---|---|
| | | CAGCGGCAGTGGATCTGGGACAGATTTCACTCTCACCATCAGCAGCC
TGGAGCCTGAAGATTTTGCAACTTATTACTGCCAACAGTATAATAGT
TACCCGTACACTTTTGGCCAGGGGACCAAGCTGGAGATCAAA |
| 377 | P1-068752 VH DNA | CAGGTGCAGCTGGTGGAGTCTGGGGGAGGCGTGGTCCAGCCTGGGAG
GTCCCTGAGACTCTCCTGTGCAGCGTCTGGATTCACCTTCAGTAGCT
ATGCCATGCACTGGGTCCGCCAGGCTCCAGGCAAGGGGCTGGAGTGG
GTGGCAGAGATATGGTATGATGGAAGTAATAAAGACTATGCAGACTC
CGTGAAGGGCCGATTCACCATCTCCAGAGACAATTCCAAGAACACGC
TGTATCTGCAAATGAACAGCCTGAGAGCCGAGGACACGGCTGTGTAT
TACTGTGCGAGAGATAGTGGTTTTTACGACTCGTACTACTTTGACGA
GTGGGGCCAGGGAACCCTGGTCACCGTCTCCTCA |
| 378 | P1-068752 VL DNA | GAAATTGTGTTGACACAGTCTCCAGCCACCCTGTCTTTGTCTCCAGG
GGAAAGAGCCACCCTCTCCTGCAGGGCCAGTCAGAGTGTTAGCAGCA
GCTACTTAGCCTGGTACCAACAGAAACCTGGCCAGGCTCCCAGGCTC
CTCATCTATGATGCATCCAACAGGGCCACTGGCATCCCAGCCAGGTT
CAGCGGCAGTGGATCTGGGACAGATTTCACTCTCACCATCAGCAGCC
TGGAGCCTGAAGATTTTGCAACTTATTACTGCCAACAGTATAATAGT
TACCCGTACACTTTTGGCCAGGGGACCAAGCTGGAGATCAAA |
| 379 | P1-068740 VH DNA | CAGGTGCAGCTGGTGGAGTCTGGGGGAGGCGTGGTCCAGCCTGGGAG
GTCCCTGAGACTCTCCTGTGCAGCGTCTGGATTCACCTTCAGTGACT
ATGCCATGCACTGGGTCCGCCAGGCTCCAGGCAAGGGGCTGGAGTGG
GTGGCAATTATATGGTATGATGGAAGTGATAAAGACTATGCAGACTC
CGTGAAGGGCCGATTCACCATCTCCAGAGACAATTCCAAGAACACGC
TGTATCTGCAAATGAACAGCCTGAGAGCCGAGGACACGGCTGTGTAT
TACTGTGCGAGAGATAGTGGTTTTTACGACTCGTACTACTTTGACGA
CTGGGGCCAGGGAACCCTGGTCACCGTCTCCTCA |
| 380 | P1-068740 VL DNA | GAAATTGTGTTGACACAGTCTCCAGCCACCCTGTCTTTGTCTCCAGG
GGAAAGAGCCACCCTCTCCTGCAGGGCCAGTCAGAGTGTTAGCAGCA
GCTACTTAGCCTGGTACCAACAGAAACCTGGCCAGGCTCCCAGGCTC
CTCATCTATGATGCATCCAACAGGGCCACTGGCATCCCAGCCAGGTT
CAGCGGCAGTGGATCTGGGACAGATTTCACTCTCACCATCAGCAGCC
TGGAGCCTGAAGATTTTGCAACTTATTACTGCCAACAGTATAATAGT
TACCCGTACACTTTTGGCCAGGGGACCAAGCTGGAGATCAAA |
| 381 | P1-068742 VH DNA | CAGGTGCAGCTGGTGGAGTCTGGGGGAGGCGTGGTCCAGCCTGGGAG
GTCCCTGAGACTCTCCTGTGCAGCGTCTGGATTCACCTTCAGTGACT
ATGCCATGCACTGGGTCCGCCAGGCTCCAGGCAAGGGGCTGGAGTGG
GTGGCAATTATATGGTATGATGGAAGTGATAAAGACTATGCAGACTC
CGTGAAGGGCCGATTCACCATCTCCAGAGACAATTCCAAGAACACGC
TGTATCTGCAAATGAACAGCCTGAGAGCCGAGGACACGGCTGTGTAT
TACTGTGCGAGAGATAGTGGTTTTTACGAAGATTACTACTTTGACTA
CTGGGGCCAGGGAACCCTGGTCACCGTCTCCTCA |
| 382 | P1-068742 VL DNA | GAAATTGTGTTGACACAGTCTCCAGCCACCCTGTCTTTGTCTCCAGG
GGAAAGAGCCACCCTCTCCTGCAGGGCCAGTCAGAGTGTTAGCAGCA
GCTACTTAGCCTGGTACCAACAGAAACCTGGCCAGGCTCCCAGGCTC
CTCATCTATGATGCATCCAACAGGGCCACTGGCATCCCAGCCAGGTT
CAGCGGCAGTGGATCTGGGACAGATTTCACTCTCACCATCAGCAGCC
TGGAGCCTGAAGATTTTGCAACTTATTACTGCCAACAGTATAATAGT
TACCCGTACACTTTTGGCCAGGGGACCAAGCTGGAGATCAAA |
| 383 | P1-068746 VH DNA | CAGGTGCAGCTGGTGGAGTCTGGGGGAGGCGTGGTCCAGCCTGGGAG
GTCCCTGAGACTCTCCTGTGCAGCGTCTGGATTCACCTTCAGTAGCT
ATGCCATGCACTGGGTCCGCCAGGCTCCAGGCAAGGGGCTGGAGTGG
GTGGCAATTATATGGTATGATGGAAGTAATCACCACTATGCAGACTC
CGTGAAGGGCCGATTCACCATCTCCAGAGACAATTCCAAGAACACGC
TGTATCTGCAAATGAACAGCCTGAGAGCCGAGGACACGGCTGTGTAT
TACTGTGCGAGAGATAGTGGTTTTTACGACTCGTACTACTTTGACTA
CTGGGGCCAGGGAACCCTGGTCACCGTCTCCTCA |
| 384 | P1-068746 VL DNA | GAAATTGTGTTGACACAGTCTCCAGCCACCCTGTCTTTGTCTCCAGG
GGAAAGAGCCACCCTCTCCTGCAGGGCCAGTCAGAGTGTTAGCAGCA
GCTACTTAGCCTGGTACCAACAGAAACCTGGCCAGGCTCCCAGGCTC
CTCATCTATGATGCATCCAACAGGGCCACTGGCA CCCAGCCAGGTT
CAGCGGCAGTGGATCTGGGACAGATTTCACTCTCACCATCAGCAGCC
TGGAGCCTGAAGATTTTGCAACTTATTACTGCCAACAGTATAATAGT
TACCCGTACACTTTTGGCCAGGGGACCAAGCTGGAGATCAAA |
| 385 | P1-068750 VH DNA | CAGGTGCAGCTGGTGGAGTCTGGGGGAGGCGTGGTCCAGCCTGGGAG
GTCCCTGAGACTCTCCTGTGCAGCGTCTGGATTCACCTTCAGTGACT
ATGACATGCACTGGGCCGCCAGGCTCCAGGCAAGGGGCTGGAGTGG
GTGGCAGAGATATGGGATGATGGAAGTAATAAATACTATGCAGACTC
CGTGAAGGGCCGATTCACCATCTCCAGAGACAATTCCAAGAACACGC
TGTATCTGCAAATGAACAGCCTGAGAGCCGAGGACACGGCTGTGTAT
TACTGTGCGAGAGATGAGGAATTTACTCCTCGTACTACTTTGACTA
CTGGGGCCAGGGAACCCTGGTCACCGTCTCCTCA |
| 386 | P1-068750 VL DNA | GAAATTGTGTTGACACAGTCTCCAGCCACCCTGTCTTTGTCTCCAGG
GGAAAGAGCCACCCTCTCCTGCAGGGCCAGTCAGAGTGTTAGCAGCA
GCTACTTAGCCTGGTACCAACAGAAACCTGGCCAGGCTCCCAGGCTC
CTCATCTATGATGCATCCAACAGGGCCACTGGCATCCCAGCCAGGTT
CAGCGGCAGTGGATCTGGGACAGATTTCACTCTCACCATCAGCAGCC |

-continued

| SEQ ID NO | Name | Sequence |
|---|---|---|
| 387 | P1-068738 VH DNA | CAGGTGCAGCTGGTGGAGTCTGGGGGAGGCGTGGTCCAGCCTGGGAG GTCCCTGAGACTCTCCTGTGCAGCGTCTGGATTCACCTTCAGTGAGT ATGCCCATCACTGGGTCCGCCAGGCTCCAGGCAAGGGGCTGGAGTGG GTGGCAATTATATGGGATGATGGAAGTAATCACTACTATGCAGACTC CGTGAAGGGCCGATTCACCATCTCCAGAGACAATTCCAAGAACACGC TGTATCTGCAAATGAACAGCCTGAGAGCCGAGGACACGGCTGTGTAT TACTGTGCGAGAGATAGTGGTTTTTACGAAGATTACTACTTTGACTA CTGGGGCCAGGGAACCCTGGTCACCGTCTCCTCA |
| 388 | P1-068738 VL DNA | GAAATTGTGTTGACACAGTCTCCAGCCACCCTGTCTTTGTCTCCAGG GGAAAGAGCCACCCTCTCCTGCAGGGCCAGTCAGAGTGTTAGCAGCA GCTACTTAGCCTGGTACCAACAGAAACCTGGCCAGGCTCCCAGGCTC CTCATCTATGATGCATCCAACAGGGCCACTGGCATCCCAGCCAGGTT CAGCGGCAGTGGATCTGGGACAGATTTCACTCTCACCATCAGCAGCC TGGAGCCTGAAGATTTTGCAACTTATTACTGCCAACAGTATAATAGT TACCCGTACACTTTTGGCCAGGGGACCAAGCTGGAGATCAAA |
| 389 | P1-068754 VH DNA | CAGGTGCAGCTGGTGGAGTCTGGGGGAGGCGTGGTCCAGCCTGGGAG GTCCCTGAGACTCTCCTGTGCAGCGTCTGGATTCACCTTCAGTGACT ATGACATGCACTGGGTCCGCCAGGCTCCAGGCAAGGGGCTGGAGTGG GTGGCAGAGATATGGGATGATGGAAGTAATAAATACTATGCAGACTC CGTGAAGGGCCGATTCACCATCTCCAGAGACAATTCCAAGAACACGC TGTATCTGCAAATGAACAGCCTGAGAGCCGAGGACACGGCTGTGTAT TACTGTGCGAGAGATAGTGGTTTTCACTCCGATTACTACTTTGACTA CTGGGGCCAGGGAACCCTGGTCACCGTCTCCTCA |
| 390 | P1-068754 VL DNA | GAAATTGTGTTGACACAGTCTCCAGCCACCCTGTCTTTGTCTCCAGG GGAAAGAGCCACCCTCTCCTGCAGGGCCAGTCAGAGTGTTAGCAGCA GCTACTTAGCCTGGTACCAACAGAAACCTGGCCAGGCTCCCAGGCTC CTCATCTATGATGCATCCAACAGGGCCACTGGCATCCCAGCCAGGTT CAGCGGCAGTGGATCTGGGACAGATTTCACTCTCACCATCAGCAGCC TGGAGCCTGAAGATTTTGCAACTTATTACTGCCAACAGTATAATAGT TACCCGTACACTTTTGGCCAGGGGACCAAGCTGGAGATCAAA |
| 391 | P1-070864 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGATGATG AGGCCATGCACTGGGTCCGGCAAGCTCCAGGGAAGGGCCTGGAGTGG GTCTCAGGTATTAATTGGAACAGTGAAGAGATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCCATGGCTGGATTGACGCTGA AGATGTCTGGGGCCAAGGGACAATGGTCACCGTCTCTTCA |
| 392 | P1-070864 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 393 | P1-070866 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGAGGATT ATGCCATGCACTGGGTCCGGCAAGCTCCAGGGAAGGGCCTGGAGTGG GTCTCAGGTATTAATTGGAACAGTGAAGAGATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCCATGGCTGGATTGACGCTGA AGATGTCTGGGGCCAAGGGACAATGGTCACCGTCTCTTCA |
| 394 | P1-070866 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 395 | P1-070868 VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGAGGATG AGGCCATGCACTGGGTCCGGCAAGCTCCAGGGAAGGGCCTGGAGTGG GTCTCAGGTATTAATTGGAACAGTGCTGAGATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCCATGGCTGGATTGACGCTGA AGATGTCTGGGGCCAAGGGACAATGGTCACCGTCTCTTCA |
| 396 | P1-070868 VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT |

| SEQ ID NO | Name | Sequence |
|---|---|---|
| | | CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAA |
| 397 | P1-070870 VH DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGAGGATG<br>AGGCCATGCACTGGGTCCGGCAAGCTCCAGGGAAGGGCCTGGAGTGG<br>GTCTCAGGTATTAATTGGAACAGTGAAAACATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCCATGGCTGGATTGACGCTGA<br>AGATGTCTGGGGCCAAGGGACAATGGTCACCGTCTCTTCA |
| 398 | P1-070870 VL DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAA |
| 399 | P1-070872 VH DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGAGGATG<br>AGGCCATGCACTGGGTCCGGCAAGCTCCAGGGAAGGGCCTGGAGTGG<br>GTCTCAGGTATTAATTGGAACAGTGAAGAGATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCCGTGGCTGGATTGACGCTGA<br>AGATGTCTGGGGCCAAGGGACAATGGTCACCGTCTCTTCA |
| 400 | P1-070872 VL DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAA |
| 401 | P1-070874 VH DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGAGGATG<br>AGGCCATGCACTGGGTCCGGCAAGCTCCAGGGAAGGGCCTGGAGTGG<br>GTCTCAGGTATTAATTGGAACAGTGAAGAGATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCCATGGCTGGATTGACGCTTT<br>TGATGTCTGGGGCCAAGGGACAATGGTCACCGTCTCTTCA |
| 402 | P1-070874 VL DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAA |
| 403 | P1-070876 VH DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGATGATT<br>ATGCCATGCACTGGGTCCGGCAAGCTCCAGGGAAGGGCCTGGAGTGG<br>GTCTCAGGTATTAATTGGAACAGTGAAGAGATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCCATGGCTGGATTGACGCTGA<br>AGATGTCTGGGGCCAAGGGACAATGGTCACCGTCTCTTCA |
| 404 | P1-070876 VL DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAA |
| 405 | P1-070878 VH DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGAGGATG<br>AGGCCATGCACTGGGTCCGGCAAGCTCCAGGGAAGGGCCTGGAGTGG<br>GTCTCAGGTATTAATTGGAACAGTGCTAACATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCCATGGCTGGATTGACGCTGA<br>AGATGTCTGGGGCCAAGGGACAATGGTCACCGTCTCTTCA |
| 406 | P1-070878 VL DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC |

| SEQ ID NO | Name | Sequence |
|---|---|---|
| | | TGGAGCCTGAAGATTTTGCAGTGTATTACTGTCAGCAGTATGGTAGC<br>TCACCATTCACTTTCGGCCCTGGGACCAAAGTGGATATCAAA |
| 407 | P1-070880 VH DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGAGGATG<br>AGGCCATGCACTGGGTCCGGCAAGCTCCAGGGAAGGGCCTGGAGTGG<br>GTCTCAGGTATTAATTGGAACAGTGAAGAGATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCGGTGGCTGGATTGACGCTTT<br>TGATGTCTGGGGCCAAGGGACAATGGTCACCGTCTCTTCA |
| 408 | P1-070880 VL DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAA |
| 409 | P1-070882 VH DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGAGGATT<br>ATGCCATGCACTGGGTCCGGCAAGCTCCAGGGAAGGGCCTGGAGTGG<br>GTCTCAGGTATTAATTGGAACAGTGCTGAGATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCCATGGCTGGATTGACGCTGA<br>AGATGTCTGGGGCCAAGGGACAATGGTCACCGTCTCTTCA |
| 410 | P1-070882 VL DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAA |
| 411 | P1-070884 VH DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGAGGATT<br>ATGCCATGCACTGGGTCCGGCAAGCTCCAGGGAAGGGCCTGGAGTGG<br>GTCTCAGGTATTAATTGGAACAGTGAAAACATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCCATGGCTGGATTGACGCTGA<br>AGATGTCTGGGGCCAAGGGACAATGGTCACCGTCTCTTCA |
| 412 | P1-070884 VL DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAA |
| 413 | P1-070886 VH DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGAGGATT<br>ATGCCATGCACTGGGTCCGGCAAGCTCCAGGGAAGGGCCTGGAGTGG<br>GTCTCAGGTATTAATTGGAACAGTGAAGAGATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCGGTGGCTGGATTGACGCTGA<br>AGATGTCTGGGGCCAAGGGACAATGGTCACCGTCTCTTCA |
| 414 | P1-070886 VL DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAA |
| 415 | P1-070888 VH DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGAGGATT<br>ATGCCATGCACTGGGTCCGGCAAGCTCCAGGGAAGGGCCTGGAGTGG<br>GTCTCAGGTATTAATTGGAACAGTGAAGAGATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCCATGGCTGGATTGACGCTTT<br>TGATGTCTGGGGCCAAGGGACAATGGTCACCGTCTCTTCA |
| 416 | P1-070888 VL DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT |

-continued

| SEQ ID NO | Name | Sequence |
|---|---|---|
| 417 | P1-070890 VH DNA | CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAA<br>GAGGTGCAGCTGGTGGAGTCTGGGGGAGGCTTGGTACAGCCTGGCAA<br>GTCCCTGAGACTCTCCTGTGCAGCCTCTGGATTCACCCTTGATGATG<br>AGGCCATGCACTGGGTCCGGCAAGCTCCAGGGAAGGGCCTGGAGTGG<br>GTCTCAGGTATTAATTGGAACAGTGCTGAGATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCCATGGCTGGATTGACGCTGA<br>AGATGTCTGGGGCCAAGGGACAATGGTCACCGTCTCTTCA |
| 418 | P1-070890 VL DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAA |
| 419 | P1-070892 VH DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGATGATG<br>AGGCCATGCACTGGGTCCGGCAAGCTCCAGGGAAGGGCCTGGAGTGG<br>GTCTCAGGTATTAATTGGAACAGTGAAAACATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCCATGGCTGGATTGACGCTGA<br>AGATGTCTGGGGCCAAGGGACAATGGTCACCGTCTCTTCA |
| 420 | P1-070892 VL DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAA |
| 421 | P1-070894 VH DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGATGATG<br>AGGCCATGCACTGGGTCCGGCAAGCTCCAGGGAAGGGCCTGGAGTGG<br>GTCTCAGGTATTAATTGGAACAGTGAAGAGATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCCGTGGCTGGATTGACGCTGA<br>AGATGTCTGGGGCCAAGGGACAATGGTCACCGTCTCTTCA |
| 422 | P1-070894 VL DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAA |
| 423 | P1-070896 VH DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGATGATG<br>AGGCCATGCACTGGGTCCGGCAAGCTCCAGGGAAGGGCCTGGAGTGG<br>GTCTCAGGTATTAATTGGAACAGTGAAGAGATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCCATGGCTGGATTGACGCTTT<br>TGATGTCTGGGGCCAAGGGACAATGGTCACCGTCTCTTCA |
| 424 | P1-070896 VL DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAA |
| 425 | P1-070898 VH DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGATGATG<br>AGGCCATGCACTGGGTCCGGCAAGCTCCAGGGAAGGGCCTGGAGTGG<br>GTCTCAGGTATTAATTGGAACAGTGCTGAGATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCCATGGCTGGATTGACGCTTT<br>TGATGTCTGGGGCCAAGGGACAATGGTCACCGTCTCTTCA |
| 426 | P1-070898 VL DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC |

| SEQ ID NO | Name | Sequence |
|---|---|---|
|  |  | TGGAGCCTGAAGATTTTGCAGTGTATTACTGTCAGCAGTATGGTAGC<br>TCACCATTCACTTTCGGCCCTGGGACCAAAGTGGATATCAAA |
| 427 | P1-070900 VH DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGAGGATG<br>AGGCCATGCACTGGGTCCGGCAAGCTCCAGGGAAGGGCCTGGAGTGG<br>GTCTCAGGTATTAATTGGAACAGTGAAAACATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCGGTGGCTGGATTGACGCTGA<br>AGATGTCTGGGGCCAAGGGACAATGGTCACCGTCTCTTCA |
| 428 | P1-070900 VL DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAA |
| 429 | P1-070902 VH DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGAGGATG<br>AGGCCATGCACTGGGTCCGGCAAGCTCCAGGGAAGGGCCTGGAGTGG<br>GTCTCAGGTATTAATTGGAACAGTGAAAACATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCCATGGCTGGATTGACGCTTT<br>TGATGTCTGGGGCCAAGGGACAATGGTCACCGTCTCTTCA |
| 430 | P1-070902 VL DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAA |
| 431 | P1-070904 VH DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGATGATT<br>ATGCCATGCACTGGGTCCGGCAAGCTCCAGGGAAGGGCCTGGAGTGG<br>GTCTCAGGTATTGATTGGAACAGTGAAAACATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCGGTGGCTGGATTGACGCTGA<br>AGATGACTGGGGCCAAGGGACAATGGTCACCGTCTCTTCA |
| 432 | P1-070904 VL DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAA |
| 433 | P1-070906 VH DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGAGGATT<br>ATGCCATGCACTGGGTCCGGCAAGCTCCAGGGAAGGGCCTGGAGTGG<br>GTCTCAGGTATTAATTGGAACAGTGAAAACATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCGGTGGCTGGATTGACGCTGA<br>AGATGACTGGGGCCAAGGGACAATGGTCACCGTCTCTTCA |
| 434 | P1-070906 VL DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAA |
| 435 | P1-070908 VH DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGAGGATT<br>ATGCCATGCACTGGGTCCGGCAAGCTCCAGGGAAGGGCCTGGAGTGG<br>GTCTCAGGTATTGATTGGAACAGTGCTAACATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCGGTGGCTGGATTGACGCTGA<br>AGATGACTGGGGCCAAGGGACAATGGTCACCGTCTCTTCA |
| 436 | P1-070908 VL DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT |

| SEQ ID NO | Name | Sequence |
|---|---|---|
| 437 | P1-070910 VH DNA | CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAA |
| 438 | P1-070910 VL DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGAGGATT<br>ATGCCATGCACTGGGTCCGGCAAGCTCCAGGGAAGGGCCTGGAGTGG<br>GTCTCAGGTATTGATTGGAACAGTGAAAACATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCGGTGGCTGGATTGACGCTTT<br>TGATGACTGGGGCCAAGGGACAATGGTCACCGTCTCTTCA |
| 439 | P1-070912 VH DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAA |
| 440 | P1-070912 VL DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGAGGATT<br>ATGCCATGCACTGGGTCCGGCAAGCTCCAGGGAAGGGCCTGGAGTGG<br>GTCTCAGGTATTGATTGGAACAGTGAAAACATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCGGTGGCTGGATTGACGCTGA<br>AGATGTCTGGGGCCAAGGGACAATGGTCACCGTCTCTTCA |
| 441 | P1-070914 VH DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAA |
| 442 | P1-070914 VL DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGATTATT<br>ATGCCATGCACTGGGTCCGGCAAGCTCCAGGGAAGGGCCTGGAGTGG<br>GTCTCAGGTATTAATTGGAACAGTGAAAACATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCGGTGGCTGGATTGACGCTGA<br>AGATGACTGGGGCCAAGGGACAATGGTCACCGTCTCTTCA |
| 443 | P1-070916 VH DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAA |
| 444 | P1-070916 VL DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGAGGATT<br>ATGCCATGCACTGGGTCCGGCAAGCTCCAGGGAAGGGCCTGGAGTGG<br>GTCTCAGGTATTGATTGGAACAGTGCTAACATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCGGTGGCTGGATTGACGCTGA<br>AGATGACTGGGGCCAAGGGACAATGGTCACCGTCTCTTCA |
| 445 | P1-070918 VH DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAA |
| 446 | P1-070918 VL DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGAGGATT<br>ATGCCATGCACTGGGTCCGGCAAGCTCCAGGGAAGGGCCTGGAGTGG<br>GTCTCAGGTATTGATTGGAACAGTGCTAACATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCGGTGGCTGGATTGACGCTTT<br>TGATGACTGGGGCCAAGGGACAATGGTCACCGTCTCTTCA |
|  | | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC |

| SEQ ID NO | Name | Sequence |
|---|---|---|
| | | TGGAGCCTGAAGATTTTGCAGTGTATTACTGTCAGCAGTATGGTAGC<br>TCACCATTCACTTTCGGCCCTGGGACCAAAGTGGATATCAAA |
| 447 | P1-070920 VH DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGAGGATT<br>ATGCCATGCACTGGGTCCGGCAAGCTCCAGGGAAGGGCCTGGAGTGG<br>GTCTCAGGTATTGATTGGAACAGTGAAAACATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCGGTGGCTGGATTGACGCTTT<br>TGATGTCTGGGGCCAAGGGACAATGGTCACCGTCTCTTCA |
| 448 | P1-070920 VL DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAA |
| 449 | P1-070922 VH DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGATGATT<br>ATGCCATGCACTGGGTCCGGCAAGCTCCAGGGAAGGGCCTGGAGTGG<br>GTCTCAGGTATTGATTGGAACAGTGCTAACATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCGGTGGCTGGATTGACGCTGA<br>AGATGACTGGGGCCAAGGGACAATGGTCACCGTCTCTTCA |
| 450 | P1-070922 VL DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAA |
| 451 | P1-070924 VH DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGATGATT<br>ATGCCATGCACTGGGTCCGGCAAGCTCCAGGGAAGGGCCTGGAGTGG<br>GTCTCAGGTATTGATTGGAACAGTGAAAACATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCGGTGGCTGGATTGACGCTTT<br>TGATGACTGGGGCCAAGGGACAATGGTCACCGTCTCTTCA |
| 452 | P1-070924 VL DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAA |
| 453 | P1-070926 VH DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGATGATT<br>ATGCCATGCACTGGGTCCGGCAAGCTCCAGGGAAGGGCCTGGAGTGG<br>GTCTCAGGTATTGATTGGAACAGTGAAAACATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCGGTGGCTGGATTGACGCTGA<br>AGATGTCTGGGGCCAAGGGACAATGGTCACCGTCTCTTCA |
| 454 | P1-070926 VL DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAA |
| 455 | P1-070928 VH DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGAGGATT<br>ATGCCATGCACTGGGTCCGGCAAGCTCCAGGGAAGGGCCTGGAGTGG<br>GTCTCAGGTATTAATTGGAACAGTGAAAACATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCGGTGGCTGGATTGACGCTTT<br>TGATGACTGGGGCCAAGGGACAATGGTCACCGTCTCTTCA |
| 456 | P1-070928 VL DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT |

| SEQ ID NO | Name | Sequence |
|---|---|---|
| 457 | P1-070930 VH DNA | CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAA<br>GAGGTGCAGCTGGTGGAGTCTGGGGGAGGCTTGGTACAGCCTGGCAA<br>GTCCCTGAGACTCTCCTGTGCAGCCTCTGGATTCACCCTTGAGGATT<br>ATGCCATGCACTGGGTCCGGCAAGCTCCAGGGAAGGGCCTGGAGTGG<br>GTCTCAGGTATTAATTGGAACAGTGAAAACATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCGGTGGCTGGATTGACGCTGA<br>AGATGTCTGGGGCCAAGGGACAATGGTCACCGTCTCTTCA |
| 458 | P1-070930 VL DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAA |
| 459 | P1-070932 VH DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGAGGATT<br>ATGCCATGCACTGGGTCCGGCAAGCTCCAGGGAAGGGCCTGGAGTGG<br>GTCTCAGGTATTGATTGGAACAGTGCTAACATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCGGTGGCTGGATTGACGCTGA<br>AGATGTCTGGGGCCAAGGGACAATGGTCACCGTCTCTTCA |
| 460 | P1-070932 VL DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAA |
| 461 | IgG1.3 heavy chain constant region DNA | GCGTCGACCAAGGGCCCATCGGTCTTCCCCCTGGCACCCTCCTCCAA<br>GAGCACCTCTGGGGGCACAGCGGCCCTGGGCTGCCTGGTCAAGGACT<br>ACTTCCCCGAACCGGTGACGGTGTCGTGGAACTCAGGCGCCCTGACC<br>AGCGGCGTGCACACCTTCCCGGCTGTCCTACAGTCCTCAGGACTCTA<br>CTCCCTCAGCAGCGTGGTGACCGTGCCCTCCAGCAGCTTGGGCACCC<br>AGACCTACATCTGCAACGTGAATCACAAGCCCAGCAACACCAAGGTG<br>GACAAGAGAGTTGAGCCCAAATCTTGTGACAAAACTCACACATGCCC<br>ACCGTGCCCAGCACCTGAAGCCGAAGGGGCCCCGTCAGTCTTCCTCT<br>TCCCCCCAAAACCCAAGGACACCCTCATGATCTCCCGGACCCCTGAG<br>GTCACATGCGTGGTGGTGGACGTGAGCCACGAAGACCCTGAGGTCAA<br>GTTCAACTGGTACGTGGACGGCGTGGAGGTGCATAATGCCAAGACAA<br>AGCCGCGGGAGGAGCAGTACAACAGCACGTACCGTGTGGTCAGCGTC<br>CTCACCGTCCTGCACCAGGACTGGCTGAATGGCAAGGAGTACAAGTG<br>CAAGGTCTCCAACAAAGCCCTCCCAGCCCCCATCGAGAAAACCATCT<br>CCAAAGCCAAAGGGCAGCCCCGAGAACCACAGGTGTACACCCTGCCC<br>CCATCCCGGGAGGAGATGACCAAGAACCAGGTCAGCCTGACCTGCCT<br>GGTCAAAGGCTTCTATCCCAGCGACATCGCCGTGGAGTGGGAGAGCA<br>ATGGGCAGCCGGAGAACAACTACAAGACCACGCCTCCCGTGCTGGAC<br>TCCGACGGCTCCTTCTTCCTCTATAGCAAGCTCACCGTGGCGTCGAC<br>CAAGGGCCCATCGGTCTTCCCCCTGGCACCCTCCTCCAAGAGCACCT<br>CTGGGGGCACAGCGGCCCTGGGCTGCCTGGTCAAGGACTACTTCCCC<br>GAACCGGTGACGGTGTCGTGGAACTCAGGCGCCCTGACCAGCGGCGT<br>GCACACCTTCCCGGCTGTCCTACAGTCCTCAGGACTCTACTCCCTCA<br>GCAGCGTGGTGACCGTGCCCTCCAGCAGCTTGGGCACCCAGACCTAC<br>ATCTGCAACGTGAATCACAAGCCCAGCAACACCAAGGTGGACAAGAG<br>AGTTGAGCCCAAATCTTGTGACAAAACTCACACATGCCCACCGTGCC<br>CAGCACCTGAAGCCGAAGGGGCCCCGTCAGTCTTCCTCTTCCCCCCA<br>AAACCCAAGGACACCCTCATGATCTCCCGGACCCCTGAGGTCACATG<br>CGTGGTGGTGGACGTGAGCCACGAAGACCCTGAGGTCAAGTTCAACT<br>GGTACGTGGACGGCGTGGAGGTGCATAATGCCAAGACAAAGCCGCGG<br>GAGGAGCAGTACAACAGCACGTACCGTGTGGTCAGCGTCCTCACCGT<br>CCTGCACCAGGACTGGCTGAATGGCAAGGAGTACAAGTGCAAGGTCT<br>CCAACAAAGCCCTCCCAGCCCCCATCGAGAAAACCATCTCCAAAGCC<br>AAAGGGCAGCCCCGAGAACCACAGGTGTACACCCTGCCCCCATCCCG<br>GGAGGAGATGACCAAGAACCAGGTCAGCCTGACCTGCCTGGTCAAAG<br>GCTTCTATCCCAGCGACATCGCCGTGGAGTGGGAGAGCAATGGGCAG<br>CCGGAGAACAACTACAAGACCACGCCTCCCGTGCTGGACTCCGACGG<br>CTCCTTCTTCCTCTATAGCAAGCTCACCGTGGACAAGAGCAGGTGGC<br>AGCAGGGGAACGTCTTCTCATGCTCCGTGATGCATGAGGCTCTGCAC<br>AACCACTACACGCAGAAGAGCCTCTCCCTGTCCCCGGGTTGA |

-continued

| SEQ ID NO | Name | Sequence |
|---|---|---|
| 462 | Exemplary light chain constant region DNA | CGTACGGTGGCTGCACCATCTGTCTTCATCTTCCCGCCATCTGATGA GCAGTTGAAATCTGGAACTGCCTCTGTTGTGTGCCTGCTGAATAACT TCTATCCCAGAGAGGCCAAAGTACAGTGGAAGGTGGATAACGCCCTC CAATCGGGTAACTCCCAGGAGAGTGTCACAGAGCAGGACAGCAAGGA CAGCACCTACAGCCTCAGCAGCACCCTGACGCTGAGCAAAGCAGACT ACGAGAAACACAAAGTCTACGCCTGCGAAGTCACCCATCAGGGCCTG AGCTCGCCCGTCACAAAGAGCTTCAACAGGGGAGAGTGTTAG |
| 463 | P1-068761 VH K16R T84A | EVQLVESGGGLVQPGRSLRLSCAASGFTLEDEAMHWVRQAPGKGLEW VSGINWNSEEIGYADSVKGRFTISRDNAKNSLYLQMNSLRAEDTALY YCAKVPGYSHGWIDAEDVWGQGTMVTVSS |
| 464 | P1-068761 VH K16R | EVQLVESGGGLVQPGRSLRLSCAASGFTLEDEAMHWVRQAPGKGLEW VSGINWNSEEIGYADSVKGRFTISRDNAKNSLYLQMNSLRTEDTALY YCAKVPGYSHGWIDAEDVWGQGTMVTVSS |
| 465 | P1-068761 VH T84A | EVQLVESGGGLVQPGKSLRLSCAASGFTLEDEAMHWVRQAPGKGLEW VSGINWNSEEIGYADSVKGRFTISRDNAKNSLYLQMNSLRAEDTALY YCAKVPGYSHGWIDAEDVWGQGTMVTVSS |
| 466 | P1-068761 K16R T84A DNA | GAGGTGCAGCTGGTGGAGTCTGGGGGAGGCTTGGTACAGCCTGGCAg GTCCCTGAGACTCTCCTGTGCAGCCTCTGGATTCACCCTTGAGGATG AGGCCATGCACTGGGTCCGGCAAGCTCCAGGGAAGGGCCTGGAGTGG GTCTCAGGTATTAATTGGAACAGTGAAGAGATAGGCTATGCGGACTC TGTGAAGGGCCGATTCACCATCTCCAGAGACAACGCCAAGAACTCCC TGTATCTGCAAATGAACAGTCTGAGAgCTGAGGACACGGCCTTGTAT TACTGTGCAAAAGTTCCTGGGTATAGCCATGGCTGGATTGACGCTGA AGATGTCTGGGGCCAAGGGACAATGGTCACCGTCTCTTCA |
| 467 | P1-061029 VH K16R T84A | EVQLVESGGGLVQPGRSLRLSCAASGFTLDDYAMHWVRQAPGKGLEW VSGINWNSANIGYADSVKGRFTISRDNAKNSLYLQMNSLRAEDTALY YCAKVPGYSGGWIDAFDVWGQGTMVTVSS |
| 468 | P1-061029 VH K16R | EVQLVESGGGLVQPGRSLRLSCAASGFTLDDYAMHWVRQAPGKGLEW VSGINWNSANIGYADSVKGRFTISRDNAKNSLYLQMNSLRTEDTALY YCAKVPGYSGGWIDAFDVWGQGTMVTVSS |
| 469 | P1-061029 VH T84A | EVQLVESGGGLVQPGKSLRLSCAASGFTLDDYAMHWVRQAPGKGLEW VSGINWNSANIGYADSVKGRFTISRDNAKNSLYLQMNSLRAEDTALY YCAKVPGYSGGWIDAFDVWGQGTMVTVSS |
| 470 | P1-061029 VH K16R T84A DNA | GAGGTGCAGCTGGTGGAGTCTGGGGGAGGCTTGGTACAGCCTGGCAg GTCCCTGAGACTCTCCTGTGCAGCCTCTGGATTCACCCTTGAGGATT ATGCCATGCACTGGGTCCGGCAAGCTCCAGGGAAGGGCCTGGAGTGG GTCTCAGGTATTAATTGGAACAGTGCTAACATAGGCTATGCGGACTC TGTGAAGGGCCGATTCACCATCTCCAGAGACAACGCCAAGAACTCCC TGTATCTGCAAATGAACAGTCTGAGAgCTGAGGACACGGCCTTGTAT TACTGTGCAAAAGTTCCTGGGTATAGCGGTGGCTGGATTGACGCTTT TGATGTCTGGGGCCAAGGGACAATGGTCACCGTCTCTTCA |
| 471 | P1-068767 VH K16R T84A | EVQLVESGGGLVQPGRSLRLSCAASGFTLEDYAMHWVRQAPGKGLEW VSGIDWNSENIGYADSVKGRFTISRDNAKNSLYLQMNSLRAEDTALY YCAKVPGYSGGWIDAEDDWGQGTMVTVSS |
| 472 | P1-068767 VH K16R | EVQLVESGGGLVQPGRSLRLSCAASGFTLEDYAMHWVRQAPGKGLEW VSGIDWNSENIGYADSVKGRFTISRDNAKNSLYLQMNSLRTEDTALY YCAKVPGYSGGWIDAEDDWGQGTMVTVSS |
| 473 | P1-068767 VH T84A | EVQLVESGGGLVQPGKSLRLSCAASGFTLEDYAMHWVRQAPGKGLEW VSGIDWNSENIGYADSVKGRFTISRDNAKNSLYLQMNSLRAEDTALY YCAKVPGYSGGWIDAEDDWGQGTMVTVSS |
| 474 | P1-068767 VH K16R T84A DNA | GAGGTGCAGCTGGTGGAGTCTGGGGGAGGCTTGGTACAGCCTGGCAg GTCCCTGAGACTCTCCTGTGCAGCCTCTGGATTCACCCTTGAGGATT ATGCCATGCACTGGGTCCGGCAAGCTCCAGGGAAGGGCCTGGAGTGG GTCTCAGGTATTGATTGGAACAGTGAAAACATAGGCTATGCGGACTC TGTGAAGGGCCGATTCACCATCTCCAGAGACAACGCCAAGAACTCCC TGTATCTGCAAATGAACAGTCTGAGAgCTGAGGACACGGCCTTGTAT TACTGTGCAAAAGTTCCTGGGTATAGCGGTGGCTGGATTGACGCTGA AGATGACTGGGGCCAAGGGACAATGGTCACCGTCTCTTCA |
| 475 | P1-070868 (P1-068761_E55A) VH K16R T84A | EVQLVESGGGLVQPGRSLRLSCAASGFTLEDEAMHWVRQAPGKGLEW VSGINWNSAEIGYADSVKGRFTISRDNAKNSLYLQMNSLRAEDTALY YCAKVPGYSHGWIDAEDVWGQGTMVTVSS |
| 476 | P1-070868 VH K16R | EVQLVESGGGLVQPGRSLRLSCAASGFTLEDEAMHWVRQAPGKGLEW VSGINWNSAEIGYADSVKGRFTISRDNAKNSLYLQMNSLRTEDTALY YCAKVPGYSHGWIDAEDVWGQGTMVTVSS |
| 477 | P1-070868 VH T84A | EVQLVESGGGLVQPGKSLRLSCAASGFTLEDEAMHWVRQAPGKGLEW VSGINWNSAEIGYADSVKGRFTISRDNAKNSLYLQMNSLRAEDTALY YCAKVPGYSHGWIDAEDVWGQGTMVTVSS |
| 478 | P1-070868 VH K16R T84A DNA | GAGGTGCAGCTGGTGGAGTCTGGGGGAGGCTTGGTACAGCCTGGCAg GTCCCTGAGACTCTCCTGTGCAGCCTCTGGATTCACCCTTGAGGATT ATGCCATGCACTGGGTCCGGCAAGCTCCAGGGAAGGGCCTGGAGTGG GTCTCAGGTATTGATTGGAACAGTGAAAACATAGGCTATGCGGACTC TGTGAAGGGCCGATTCACCATCTCCAGAGACAACGCCAAGAACTCCC TGTATCTGCAAATGAACAGTCTGAGAgCTGAGGACACGGCCTTGTAT TACTGTGCAAAAGTTCCTGGGTATAGCGGTGGCTGGATTGACGCTGA AGATGACTGGGGCCAAGGGACAATGGTCACCGTCTCTTCA |

-continued

| SEQ ID NO | Name | Sequence |
|---|---|---|
| 479 | P1-70906(P1-068767_D52N) VH K16R T84A | EVQLVESGGGLVQPGRSLRLSCAASGFTLEDYAMHWVRQAPGKGLEW VSGINWNSENIGYADSVKGRFTISRDNAKNSLYLQMNSLRAEDTALY YCAKVPGYSGGWIDAEDDWGQGTMVTVSS |
| 480 | P1-70906 VH K16R | EVQLVESGGGLVQPGRSLRLSCAASGFTLEDYAMHWVRQAPGKGLEW VSGINWNSENIGYADSVKGRFTISRDNAKNSLYLQMNSLRTEDTALY YCAKVPGYSGGWIDAEDDWGQGTMVTVSS |
| 481 | P1-70906 VH T84A | EVQLVESGGGLVQPGKSLRLSCAASGFTLEDYAMHWVRQAPGKGLEW VSGINWNSENIGYADSVKGRFTISRDNAKNSLYLQMNSLRAEDTALY YCAKVPGYSGGWIDAEDDWGQGTMVTVSS |
| 482 | P1-70906 VH K16R T84A DNA | GAGGTGCAGCTGGTGGAGTCTGGGGGAGGCTTGGTACAGCCTGGCAg GTCCCTGAGACTCTCCTGTGCAGCCTCTGGATTCACCCTTGAGGATT ATGCCATGCACTGGGTCCGGCAAGCTCCAGGGAAGGGCCTGGAGTGG GTCTCAGGTATTAATTGGAACAGTGAAAACATAGGCTATGCGGACTC TGTGAAGGGCCGATTCACCATCTCCAGAGACAACGCCAAGAACTCCC TGTATCTGCAAATGAACAGTCTGAGAgCTGAGGACACGGCCTTGTAT TACTGTGCAAAAGTTCCTGGGTATAGCGGTGGCTGGATTGACGCTGA AGATGACTGGGGCCAAGGGACAATGGTCACCGTCTCTTCA |
| 483 | P1-70908 068767_E55A) VH K16R T84A | EVQLVESGGGLVQPGRSLRLSCAASGFTLEDYAMHWVRQAPGKGLEW VSGIDWNSANIGYADSVKGRFTISRDNAKNSLYLQMNSLRAEDTALY YCAKVPGYSGGWIDAEDDWGQGTMVTVSS |
| 484 | P1-70908 VH K16R | EVQLVESGGGLVQPGRSLRLSCAASGFTLEDYAMHWVRQAPGKGLEW VSGIDWNSANIGYADSVKGRFTISRDNAKNSLYLQMNSLRTEDTALY YCAKVPGYSGGWIDAEDDWGQGTMVTVSS |
| 485 | P1-70908 VH T84A | EVQLVESGGGLVQPGKSLRLSCAASGFTLEDYAMHWVRQAPGKGLEW VSGIDWNSANIGYADSVKGRFTISRDNAKNSLYLQMNSLRAEDTALY YCAKVPGYSGGWIDAEDDWGQGTMVTVSS |
| 486 | P1-70908 VH K16R T84A DNA | GAGGTGCAGCTGGTGGAGTCTGGGGGAGGCTTGGTACAGCCTGGCAg GTCCCTGAGACTCTCCTGTGCAGCCTCTGGATTCACCCTTGAGGATT ATGCCATGCACTGGGTCCGGCAAGCTCCAGGGAAGGGCCTGGAGTGG GTCTCAGGTATTGATTGGAACAGTGCTAACATAGGCTATGCGGACTC TGTGAAGGGCCGATTCACCATCTCCAGAGACAACGCCAAGAACTCCC TGTATCTGCAAATGAACAGTCTGAGAgCTGAGGACACGGCCTTGTAT TACTGTGCAAAAGTTCCTGGGTATAGCGGTGGCTGGATTGACGCTGA AGATGACTGGGGCCAAGGGACAATGGTCACCGTCTCTTCA |
| 487 | P1-70916 (P1-068767_D52N E55A) VH K16R T84A | EVQLVESGGGLVQPGRSLRLSCAASGFTLEDYAMHWVRQAPGKGLEW VSGINWNSANIGYADSVKGRFTISRDNAKNSLYLQMNSLRAEDTALY YCAKVPGYSGGWIDAEDDWGQGTMVTVSS |
| 488 | P1-70916 VH K16R | EVQLVESGGGLVQPGRSLRLSCAASGFTLEDYAMHWVRQAPGKGLEW VSGINWNSANIGYADSVKGRFTISRDNAKNSLYLQMNSLRTEDTALY YCAKVPGYSGGWIDAEDDWGQGTMVTVSS |
| 489 | P1-70916 VH T84A | EVQLVESGGGLVQPGKSLRLSCAASGFTLEDYAMHWVRQAPGKGLEW VSGINWNSANIGYADSVKGRFTISRDNAKNSLYLQMNSLRAEDTALY YCAKVPGYSGGWIDAEDDWGQGTMVTVSS |
| 490 | P1-70916 VH K16R T84A DNA | GAGGTGCAGCTGGTGGAGTCTGGGGGAGGCTTGGTACAGCCTGGCAg GTCCCTGAGACTCTCCTGTGCAGCCTCTGGATTCACCCTTGAGGATT ATGCCATGCACTGGGTCCGGCAAGCTCCAGGGAAGGGCCTGGAGTGG GTCTCAGGTATTAATTGGAACAGTGCTAACATAGGCTATGCGGACTC TGTGAAGGGCCGATTCACCATCTCCAGAGACAACGCCAAGAACTCCC TGTATCTGCAAATGAACAGTCTGAGAgCTGAGGACACGGCCTTGTAT TACTGTGCAAAAGTTCCTGGGTATAGCGGTGGCTGGATTGACGCTGA AGATGACTGGGGCCAAGGGACAATGGTCACCGTCTCTTCA |
| 491 | P1-72000 (P1-061029_F100fE_V10 2D) VH | EVQLVESGGGLVQPGKSLRLSCAASGFTLDDYAMHWVRQAPGKGLEW VSGINWNSANIGYADSVKGRFTISRDNAKNSLYLQMNSLRTEDTALY YCAKVPGYSGGWIDAEDDWGQGTMVTVSS |
| 492 | P1-72000 (P1-061029_F100fE_V10 2D) VL | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 493 | P1-72000 (P1-061029_F100fE_V10 2D) HC | EVQLVESGGGLVQPGKSLRLSCAASGFTLDDYAMHWVRQAPGKGLEW VSGINWNSANIGYADSVKGRFTISRDNAKNSLYLQMNSLRTEDTALY YCAKVPGYSGGWIDAEDDWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 494 | P1-72000 (P1-061029_F100fE_V10 2D) LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |

-continued

| SEQ ID NO | Name | Sequence |
|---|---|---|
| 495 | P1-72000 (P1-061029_F100fE_V10 2D) VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGATGATT ATGCCATGCACTGGGTCCGGCAAGCTCCAGGGAAGGGCCTGGAGTGG GTCTCAGGTATTAATTGGAACAGTGCTAACATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCGGTGGCTGGATTGACGCTGA GGATGACTGGGGCCAAGGGACAATGGTCACCGTCTCTTCA |
| 496 | P1-72000 (P1-061029_F100fE_V10 2D ) VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 497 | P1-72000 ( P1-061029_F100fE_V10 2D) HC DNA | GAGGTGCAGCTGGTGGAGTCTGGGGGAGGCTTGGTACAGCCTGGCAA GTCCCTGAGACTCTCCTGTGCAGCCTCTGGATTCACCCTTGATGATT ATGCCATGCACTGGGTCCGGCAAGCTCCAGGGAAGGGCCTGGAGTGG GTCTCAGGTATTAATTGGAACAGTGCTAACATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCGGTGGCTGGATTGACGCTGA GGATGACTGGGGCCAAGGGACAATGGTCACCGTCTCTTCAGCGTCGA CCAAGGGCCCATCGGTCTTCCCCCTGGCACCCTCCTCCAAGAGCACC TCTGGGGGCACAGCGGCCCTGGGCTGCCTGGTCAAGGACTACTTCCC CGAACCGGTGACGGTGTCGTGGAACTCAGGCGCCCTGACCAGCGGCG TGCACACCTTCCCGGCTGTCCTACAGTCCTCAGGACTCTACTCCCTC AGCAGCGTGGTGACCGTGCCCTCCAGCAGCTTGGGCACCCAGACCTA CATCTGCAACGTGAATCACAAGCCCAGCAACACCAAGGTGGACAAGA GAGTTGAGCCCAAATCTTGTGACAAAACTCACACATGCCCACCGTGC CCAGCACCTGAAGCCGAAGGGGCCCCGTCAGTCTTCCTCTTCCCCCC AAAACCCAAGGACACCCTCATGATCTCCCGGACCCCTGAGGTCACAT GCGTGGTGGTGGACGTGAGCCACGAAGACCCTGAGGTCAAGTTCAAC TGGTACGTGGACGGCGTGGAGGTGCATAATGCCAAGACAAAGCCGCG GGAGGAGCAGTACAACAGCACGTACCGTGTGGTCAGCGTCCTCACCG TCCTGCACCAGGACTGGCTGAATGGCAAGGAGTACAAGTGCAAGGTC TCCAACAAAGCCCTCCCAGCCCCCATCGAGAAAACCATCTCCAAAGC CAAAGGGCAGCCCCGAGAACCACAGGTGTACACCCTGCCCCCATCCC GGGAGGAGATGACCAAGAACCAGGTCAGCCTGACCTGCCTGGTCAAA GGCTTCTATCCCAGCGACATCGCCGTGGAGTGGGAGAGCAATGGGCA GCCGGAGAACAACTACAAGACCACGCCTCCCGTGCTGGACTCCGACG GCTCCTTCTTCCTCTATAGCAAGCTCACCGTGGACAAGAGCAGGTGG CAGCAGGGGAACGTCTTCTCATGCTCCGTGATGCATGAGGCTCTGCA CAACCACTACACGCAGAAGAGCCTCTCCCTGTCCCCGGGTTGA |
| 498 | P1-72000 (P1-061029_F100fE_V10 2D) LC DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAACGTAC GGTGGCTGCACCATCTGTCTTCATCTTCCCGCCATCTGATGAGCAGT TGAAATCTGGAACTGCCTCTGTTGTGTGCCTGCTGAATAACTTCTAT CCCAGAGAGGCCAAAGTACAGTGGAAGGTGGATAACGCCCTCCAATC GGGTAACTCCCAGGAGAGTGTCACAGAGCAGGACAGCAAGGACAGCA CCTACAGCCTCAGCAGCACCCTGACGCTGAGCAAAGCAGACTACGAG AAACACAAAGTCTACGCCTGCGAAGTCACCCATCAGGGCCTGAGCTC GCCCGTCACAAAGAGCTTCAACAGGGGAGAGTGTTAG |
| 499 | P1-72000 (P1-061029_F100fE_V10 2D) VH K16R | EVQLVESGGGLVQPGRSLRLSCAASGFTLDDYAMHWVRQAPGKGLEW VSGINWNSANIGYADSVKGRFTISRDNAKNSLYLQMNSLRAEDTALY T84AYCAKVPGYSGGWIDAEDDWQGTMVTVSS |
| 500 | P1-72000 (P1-061029_F100fE_V10 2D) VH K16R | EVQLVESGGGLVQPGRSLRLSCAASGFTLDDYAMHWVRQAPGKGLEW VSGINWNSANIGYADSVKGRFTISRDNAKNSLYLQMNSLRTEDTALY YCAKVPGYSGGWIDAEDDWQGTMVTVSS |
| 501 | P1-72000 (P1-061029_F100fE_V10 2D) VH T84A | EVQLVESGGGLVQPGKSLRLSCAASGFTLDDYAMHWVRQAPGKGLEW VSGINWNSANIGYADSVKGRFTISRDNAKNSLYLQMNSLRAEDTALY YCAKVPGYSGGWIDAEDDWQGTMVTVSS |
| 502 | P1-72000 (P1-061029_F100fE_V10 2D) VH K16R T84A DNA | GAGGTGCAGCTGGTGGAGTCTGGGGGAGGCTTGGTACAGCCTGGCAg GTCCCTGAGACTCTCCTGTGCAGCCTCTGGATTCACCCTTGATGATT ATGCCATGCACTGGGTCCGGCAAGCTCCAGGGAAGGGCCTGGAGTGG GTCTCAGGTATTAATTGGAACAGTGCTAACATAGGCTATGCGGACTC TGTGAAGGGCCGATTCACCATCTCCAGAGACAACGCCAAGAACTCCC TGTATCTGCAAATGAACAGTCTGAGAgCTGAGGACACGGCCTTGTAT TACTGTGCAAAAGTTCCTGGGTATAGCGGTGGCTGGATTGACGCTGA GGATGACTGGGGCCAAGGGACAATGGTCACCGTCTCTTCA |

| SEQ ID NO | Name | Sequence |
|---|---|---|
| 503 | P1-72002 (P1-061029_F100fE) VH | EVQLVESGGGLVQPGKSLRLSCAASGFTLDDYAMHWVRQAPGKGLEW VSGINWNSANIGYADSVKGRFTISRDNAKNSLYLQMNSLRTEDTALY YCAKVPGYSGGWIDAEDVWGQGTMVTVSS |
| 504 | P1-72002 (P1-061029_F100fE) VL | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 505 | P1-72002 (P1-061029_F100fE) HC | EVQLVESGGGLVQPGKSLRLSCAASGFTLDDYAMHWVRQAPGKGLEW VSGINWNSANIGYADSVKGRFTISRDNAKNSLYLQMNSLRTEDTALY YCAKVPGYSGGWIDAEDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |
| 506 | P1-72002 (P1-061029_F100fE) LC | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 507 | P1-72002 061029_F100fE ) VH DNA | GAGGTGCAGCTGGTGGAGTCTGGGGGAGGCTTGGTACAGCCTGGCAA GTCCCTGAGACTCTCCTGTGCAGCCTCTGGATTCACCCTTGATGATT ATGCCATGCACTGGGTCCGGCAAGCTCCAGGGAAGGGCCTGGAGTGG GTCTCAGGTATTAATTGGAACAGTGCTAACATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCGGTGGCTGGATTGACGCTGA GGTGTCTGGGGCCAAGGGACAATGGTCACCGTCTCTTCA |
| 508 | P1-72002 (P1-061029_F100fE) VL DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAA |
| 509 | P1-72002 (P1-061029_F100fE) HC DNA | GAGGTGCAGCTGGTGGAGTCTGGGGGAGGCTTGGTACAGCCTGGCAA GTCCCTGAGACTCTCCTGTGCAGCCTCTGGATTCACCCTTGATGATT ATGCCATGCACTGGGTCCGGCAAGCTCCAGGGAAGGGCCTGGAGTGG GTCTCAGGTATTAATTGGAACAGTGCTAACATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCGGTGGCTGGATTGACGCTGA GGATGTCTGGGGCCAAGGGACAATGGTCACCGTCTCTTCAGCGTCGA CCAAGGGCCCATCGGTCTTCCCCCTGGCACCCTCCTCCAAGAGCACC TCTGGGGGCACAGCGGCCCTGGGCTGCCTGGTCAAGGACTACTTCCC CGAACCGGTGACGGTGTCGTGGAACTCAGGCGCCCTGACCAGCGGCG TGCACACCTTCCCGGCTGTCCTACAGTCCTCAGGACTCTACTCCCTC AGCAGCGTGGTGACCGTGCCCTCCAGCAGCTTGGGCACCCAGACCTA CATCTGCAACGTGAATCACAAGCCCAGCAACACCAAGGTGGACAAGA GAGTTGAGCCCAAATCTTGTGACAAAACTCACACATGCCCACCGTGC CCAGCACCTGAAGCCGAAGGGGCCCCGTCAGTCTTCCTCTTCCCCCC AAAACCCAAGGACACCCTCATGATCTCCCGGACCCCTGAGGTCACAT GCGTGGTGGTGGACGTGAGCCACGAAGACCCTGAGGTCAAGTTCAAC TGGTACGTGGACGGCGTGGAGGTGCATAATGCCAAGACAAAGCCGCG GGAGGAGCAGTACAACAGCACGTACCGTGTGGTCAGCGTCCTCACCG TCCTGCACCAGGACTGGCTGAATGGCAAGGAGTACAAGTGCAAGGTC TCCAACAAAGCCCTCCCAGCCCCCATCGAGAAAACCATCTCCAAAGC CAAAGGGCAGCCCCGAGAACCACAGGTGTACACCCTGCCCCCATCCC GGGAGGAGATGACCAAGAACCAGGTCAGCCTGACCTGCCTGGTCAAA GGCTTCTATCCCAGCGACATCGCCGTGGAGTGGGAGAGCAATGGGCA GCCGGAGAACAACTACAAGACCACGCCTCCCGTGCTGGACTCCGACG GCTCCTTCTTCCTCTATAGCAAGCTCACCGTGGACAAGAGCAGGTGG CAGCAGGGGAACGTCTTCTCATGCTCCGTGATGCATGAGGCTCTGCA CAACCACTACACGCAGAAGAGCCTCTCCCTGTCCCCGGGTTGA |
| 510 | P1-72002 (P1-061029_F100fE) LC DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAACGTAC GGTGGCTGCACCATCTGTCTTCATCTTCCCGCCATCTGATGAGCAGT TGAAATCTGGAACTGCCTCTGTTGTGTGCCTGCTGAATAACTTCTAT CCCAGAGAGGCCAAAGTACAGTGGAAGGTGGATAACGCCCTCCAATC GGGTAACTCCCAGGAGAGTGTCACAGAGCAGGACAGCAAGGACAGCA |

| SEQ ID NO | Name | Sequence |
|---|---|---|
| | | CCTACAGCCTCAGCAGCACCCTGACGCTGAGCAAAGCAGACTACGAG<br>AAACACAAAGTCTACGCCTGCGAAGTCACCCATCAGGGCCTGAGCTC<br>GCCCGTCACAAAGAGCTTCAACAGGGGAGAGTGTTAG |
| 511 | P1-72002 (P1-061-29_F100fE) VH K16R T84A | EVQLVESGGGLVQPGRSLRLSCAASGFTLDDYAMHWVRQAPGKGLEW<br>VSGINWNSANIGYADSVKGRFTISRDNAKNSLYLQMNSLRAEDTALY<br>YCAKVPGYSGGWIDAEDVWGQGTMVTVSS |
| 512 | P1-72002 (P1-061029_F100fE) VH K16R | EVQLVESGGGLVQPGRSLRLSCAASGFTLDDYAMHWVRQAPGKGLEW<br>VSGINWNSANIGYADSVKGRFTISRDNAKNSLYLQMNSLRTEDTALY<br>YCAKVPGYSGGWIDAEDVWGQGTMVTVSS |
| 513 | P1-72002 (P1-061029_F100fE) VH T84A | EVQLVESGGGLVQPGKSLRLSCAASGFTLDDYAMHWVRQAPGKGLEW<br>VSGINWNSANIGYADSVKGRFTISRDNAKNSLYLQMNSLRAEDTALY<br>YCAKVPGYSGGWIDAEDDWGQGTMVTVSS |
| 514 | P1-72002 (P1--61029_F100fE) VH K16R T84A DNA | GAGGTGCAGCTGGTGGAGTCTGGGGGAGGCTTGGTACAGCCTGGCAg<br>GTCCCTGAGACTCTCCTGTGCAGCCTCTGGATTCACCCTTGATGATT<br>ATGCCATGCACTGGGTCCGGCAAGCTCCAGGGAAGGGCCTGGAGTGG<br>GTCTCAGGTATTAATTGGAACAGTGCTAACATAGGCTATGCGGACTC<br>TGTGAAGGGCCGATTCACCATCTCCAGAGACAACGCCAAGAACT<br>TGTATCTGCAAATGAACAGTCTGAGAgCTGAGGACACGGCCTTGTAT<br>TACTGTGCAAAAGTTCCTGGGTATAGCGGTGGCTGGATTGACGCTGA<br>GGATGTCTGGGGCCAAGGGACAATGGTCACCGTCTCTTCA |
| 515 | P1-72004 (P1-061029_V102D ) VH | EVQLVESGGGLVQPGKSLRLSCAASGFTLDDYAMHWVRQAPGKGLEW<br>VSGINWNSANIGYADSVKGRFTISRDNAKNSLYLQMNSLRTEDTALY<br>YCAKVPGYSGGWIDAFDDWGQGTMVTVSS |
| 516 | P1-72004 (P1-061029_V102D) VL | EIVLTQSPGTLSLSPGERATLSCRASQSVSSSYLAWYQQKPGQAPRL<br>LIYGASSRATGIPDRFSGSGSGTDFTLTISRLEPEDFAVYYCQQYGS<br>SPFTFGPGTKVDIK |
| 517 | P1-72004 (P1-061029_V102D) HC | EVQLVESGGGLVQPGKSLRLSCAASGFTLDDYAMHWVRQAPGKGLEW<br>VSGINWNSANIGYADSVKGRFTISRDNAKNSLYLQMNSLRTEDTALY<br>YCAKVPGYSGGWIDAFDDWGQGTMVTVSSASTKGPSVFPLAPSSKST<br>SGGTAALGCLVKDYFPEPVTVSWNSGALTSGVHTFPAVLQSSGLYSL<br>SSVVTVPSSSLGTQTYICNVNHKPSNTKVDKRVEPKSCDKTHTCPPC<br>PAPEAEGAPSVFLFPPKPKDTLMISRTPEVTCVVVDVSHEDPEVKFN<br>WYVDGVEVHNAKTKPREEQYNSTYRVVSVLTVLHQDWLNGKEYKCKV<br>SNKALPAPIEKTISKAKGQPREPQVYTLPPSREEMTKNQVSLTCLVK<br>GFYPSDIAVEWESNGQPENNYKTTPPVLDSDGSFFLYSKLTVDKSRW<br>QQGNVFSCSVMHEALHNHYTQKSLSLSPG |
| 518 | P1-72004 (P1-061029_V102D) LC | EIVLTQSPGTLSLSPGERATLSCRASQSVSSSYLAWYQQKPGQAPRL<br>LIYGASSRATGIPDRFSGSGSGTDFTLTISRLEPEDFAVYYCQQYGS<br>SPFTFGPGTKVDIKRTVAAPSVFIFPPSDEQLKSGTASVVCLLNNFY<br>PREAKVQWKVDNALQSGNSQESVTEQDSKDSTYSLSSTLTLSKADYE<br>KHKVYACEVTHQGLSSPVTKSFNRGEC |
| 519 | P1-72004 (P1-061029_V102D) VH DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGATGATT<br>ATGCCATGCACTGGGTCCGGCAAGCTCCAGGGAAGGGCCTGGAGTGG<br>GTCTCAGGTATTAATTGGAACAGTGCTAACATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCGGTGGCTGGATTGACGCTTT<br>TGATGACTGGGGCCAAGGGACAATGGTCACCGTCTCTTCA |
| 520 | P1-72004 (P1-061029_V102D) VL DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAA |
| 521 | P1-72004 (P1-061029_V102D) HC DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGATGATT<br>ATGCCATGCACTGGGTCCGGCAAGCTCCAGGGAAGGGCCTGGAGTGG<br>GTCTCAGGTATTAATTGGAACAGTGCTAACATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCGGTGGCTGGATTGACGCTTT<br>TGATGACTGGGGCCAAGGGACAATGGTCACCGTCTCTTCAGCGTCGA<br>CCAAGGGCCCATCGGTCTTCCCCCTGGCACCCTCCTCCAAGAGCACC<br>TCTGGGGGCACAGCGGCCCTGGGCTGCCTGGTCAAGGACTACTTCCC<br>CGAACCGGTGACGGTGTCGTGGAACTCAGGCGCCCTGACCAGCGGCG<br>TGCACACCTTCCCGGCTGTCCTACAGTCCTCAGGACTCTACTCCCTC<br>AGCAGCGTGGTGACCGTGCCCTCCAGCAGCTTGGGCACCCAGACCTA<br>CATCTGCAACGTGAATCACAAGCCCAGCAACACCAAGGTGGACAAGA<br>GAGTTGAGCCCAAATCTTGTGACAAAACTCACACATGCCCACCGTGC<br>CCAGCACCTGAAGCCGAAGGGGCCCCGTCAGTCTTCCTCTTCCCCCC<br>AAAACCCAAGGACACCCTCATGATCTCCCGGACCCCTGAGGTCACAT<br>GCGTGGTGGTGGACGTGAGCCACGAAGACCCTGAGGTCAAGTTCAAC<br>TGGTACGTGGACGGCGTGGAGGTGCATAATGCCAAGACAAAGCCGCG<br>GGAGGAGCAGTACAACAGCACGTACCGTGTGGTCAGCGTCCTCACCG |

-continued

| SEQ ID NO | Name | Sequence |
|---|---|---|
| | | TCCTGCACCAGGACTGGCTGAATGGCAAGGAGTACAAGTGCAAGGTC<br>TCCAACAAAGCCCTCCCAGCCCCCATCGAGAAAACCATCTCCAAAGC<br>CAAAGGGCAGCCCCGAGAACCACAGGTGTACACCCTGCCCCCATCCC<br>GGGAGGAGATGACCAAGAACCAGGTCAGCCTGACCTGCCTGGTCAAA<br>GGCTTCTATCCCAGCGACATCGCCGTGGAGTGGGAGAGCAATGGGCA<br>GCCGGAGAACAACTACAAGACCACGCCTCCCGTGCTGGACTCCGACG<br>GCTCCTTCTTCCTCTATAGCAAGCTCACCGTGGACAAGAGCAGGTGG<br>CAGCAGGGGAACGTCTTCTCATGCTCCGTGATGCATGAGGCTCTGCA<br>CAACCACTACACGCAGAAGAGCCTCTCCCTGTCCCCGGGTTGA |
| 522 | P1-72004 (P1-061029_V102D) LC DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAACGTAC<br>GGTGGCTGCACCATCTGTCTTCATCTTCCCGCCATCTGATGAGCAGT<br>TGAAATCTGGAACTGCCTCTGTTGTGTGCCTGCTGAATAACTTCTAT<br>CCCAGAGAGGCCAAAGTACAGTGGAAGGTGGATAACGCCCTCCAATC<br>GGGTAACTCCCAGGAGAGTGTCACAGAGCAGGACAGCAAGGACAGCA<br>CCTACAGCCTCAGCAGCACCCTGACGCTGAGCAAAGCAGACTACGAG<br>AAACACAAAGTCTACGCCTGCGAAGTCACCCATCAGGGCCTGAGCTC<br>GCCCGTCACAAAGAGCTTCAACAGGGGAGAGTGTTAG |
| 523 | P1-72004 (P1-061029_V102D) VH K16R T84A | EVQLVESGGGLVQPGRSLRLSCAASGFTLDDYAMHWVRQAPGKGLEW<br>VSGINWNSANIGYADSVKGRFTISRDNAKNSLYLQMNSLRAEDTALY<br>YCAKVPGYSGGWIDAFDDWGQGTMVTVSS |
| 524 | P1-72004 (P1-061029_V102D) VH K16R | EVQLVESGGGLVQPGRSLRLSCAASGFTLDDYAMHWVRQAPGKGLEW<br>VSGINWNSANIGYADSVKGRFTISRDNAKNSLYLQMNSLRTEDTALY<br>YCAKVPGYSGGWIDAFDDWGQGTMVTVSS |
| 525 | P1-72004 (P1-061029_V102D) VH T84A | EVQLVESGGGLVQPGKSLRLSCAASGFTLDDYAMHWVRQAPGKGLEW<br>VSGINWNSANIGYADSVKGRFTISRDNAKNSLYLQMNSLRAEDTALY<br>YCAKVPGYSGGWIDAFDDWGQGTMVTVSS |
| 526 | P1-72004 (P1-061029_V102D) VH K16R T84A DNA | GAGGTGCAGCTGGTGGAGTCTGGGGGAGGCTTGGTACAGCCTGGCAg<br>GTCCCTGAGACTCTCCTGTGCAGCCTCTGGATTCACCCTTGATGATT<br>ATGCCATGCACTGGGTCCGGCAAGCTCCAGGGAAGGGCCTGGAGTGG<br>GTCTCAGGTATTAATTGGAACAGTGCTAACATAGGCTATGCGGACTC<br>TGTGAAGGGCCGATTCACCATCTCCAGAGACAACGCCAAGAACTCCC<br>TGTATCTGCAAATGAACAGTCTGAGAgCTGAGGACACGGCCTTGTAT<br>TACTGTGCAAAAGTTCCTGGGTATAGCGGTGGCTGGATTGACGCTTT<br>TGATGACTGGGGCCAAGGGACAATGGTCACCGTCTCTTCA |
| 527 | P1-72006 (P1-061029_Y32E) VH | EVQLVESGGGLVQPGKSLRLSCAASGFTLDDEAMHWVRQAPGKGLEW<br>VSGINWNSANIGYADSVKGRFTISRDNAKNSLYLQMNSLRTEDTALY<br>YCAKVPGYSGGWIDAFDVWGQGTMVTVSS |
| 528 | P1-72006 (P1-061029_Y32E) VL | EIVLTQSPGTLSLSPGERATLSCRASQSVSSSYLAWYQQKPGQAPRL<br>LIYGASSRATGIPDRFSGSGSGTDFTLTISRLEPEDFAVYYCQQYGS<br>SPFTFGPGTKVDIK |
| 529 | P1-72006 (P1-061029_Y32E) HC | EVQLVESGGGLVQPGKSLRLSCAASGFTLDDEAMHWVRQAPGKGLEW<br>VSGINWNSANIGYADSVKGRFTISRDNAKNSLYLQMNSLRTEDTALY<br>YCAKVPGYSGGWIDAFDVWGQGTMVTVSSASTKGPSVFPLAPSSKST<br>SGGTAALGCLVKDYFPEPVTVSWNSGALTSGVHTFPAVLQSSGLYSL<br>SSVVTVPSSSLGTQTYICNVNHKPSNTKVDKRVEPKSCDKTHTCPPC<br>PAPEAEGAPSVFLFPPKPKDTLMISRTPEVTCVVVDVSHEDPEVKFN<br>WYVDGVEVHNAKTKPREEQYNSTYRVVSVLTVLHQDWLNGKEYKCKV<br>SNKALPAPIEKTISKAKGQPREPQVYTLPPSREEMTKNQVSLTCLVK<br>GFYPSDIAVEWESNGQPENNYKTTPPVLDSDGSFFLYSKLTVDKSRW<br>QQGNVFSCSVMHEALHNHYTQKSLSLSPG |
| 530 | P1-72006 (P1-061029_Y32E) LC | EIVLTQSPGTLSLSPGERATLSCRASQSVSSSYLAWYQQKPGQAPRL<br>LIYGASSRATGIPDRFSGSGSGTDFTLTISRLEPEDFAVYYCQQYGS<br>SPFTFGPGTKVDIKRTVAAPSVFIFPPSDEQLKSGTASVVCLLNNFY<br>PREAKVQWKVDNALQSGNSQESVTEQDSKDSTYSLSSTLTLSKADYE<br>KHKVYACEVTHQGLSSPVTKSFNRGEC |
| 531 | P1-72006 (P1-061029_Y32E) VH DNA | GAGGTGCAGCTGGTGGAGTCTGGGGGAGGCTTGGTACAGCCTGGCAA<br>GTCCCTGAGACTCTCCTGTGCAGCCTCTGGATTCACCCTTGATGATG<br>AGGCCATGCACTGGGTCCGGCAAGCTCCAGGGAAGGGCCTGGAGTGG<br>GTCTCAGGTATTAATTGGAACAGTGCTAACATAGGCTATGCGGACTC<br>TGTGAAGGGCCGATTCACCATCTCCAGAGACAACGCCAAGAACTCCC<br>TGTATCTGCAAATGAACAGTCTGAGAACTGAGGACACGGCCTTGTAT<br>TACTGTGCAAAAGTTCCTGGGTATAGCGGTGGCTGGATTGACGCTTT<br>TGATGTCTGGGGCCAAGGGACAATGGTCACCGTCTCTTCA |
| 532 | P1-72006 (P1-061029_Y32E) VL DNA | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATCTATGGTGCATCCAGCAGGGCCACTGGCATCCCAGACAGGTT<br>CAGTGGCAGTGGGTCTGGGACAGACTTCACTCTCACCATCAGCAGAC<br>TGGAGCCTGAAGATTTTGCAGTGTATTACTGTCAGCAGTATGGTAGC<br>TCACCATTCACTTTCGGCCCTGGGACCAAAGTGGATATCAAA |

-continued

| SEQ ID NO | Name | Sequence |
|---|---|---|
| 533 | P1-72006 (P1-061029_Y32E) HC DNA | GAGGTGCAGCTGGTGGAGTCTGGGGGAGGCTTGGTACAGCCTGGCAA GTCCCTGAGACTCTCCTGTGCAGCCTCTGGATTCACCCTTGATGATG AGGCCATGCACTGGGTCCGGCAAGCTCCAGGGAAGGGCCTGGAGTGG GTCTCAGGTATTAATTGGAACAGTGCTAACATAGGCTATGCGGACTC TGTGAAGGGCCGATTCACCATCTCCAGAGACAACGCCAAGAACTCCC TGTATCTGCAAATGAACAGTCTGAGAACTGAGGACACGGCCTTGTAT TACTGTGCAAAAGTTCCTGGGTATAGCGGTGGCTGGATTGACGCTTT TGATGTCTGGGGCCAAGGGACAATGGTCACCGTCTCTTCAGCGTCGA CCAAGGGCCCATCGGTCTTCCCCCTGGCACCCTCCTCCAAGAGCACC TCTGGGGGCACAGCGGCCCTGGGCTGCCTGGTCAAGGACTACTTCCC CGAACCGGTGACGGTGTCGTGGAACTCAGGCGCCCTGACCAGCGGCG TGCACACCTTCCCGGCTGTCCTACAGTCCTCAGGACTCTACTCCCTC AGCAGCGTGGTGACCGTGCCCTCCAGCAGCTTGGGCACCCAGACCTA CATCTGCAACGTGAATCACAAGCCCAGCAACACCAAGGTGGACAAGA GAGTTGAGCCCAAATCTTGTGACAAAACTCACACATGCCCACCGTGC CCAGCACCTGAAGCCGAAGGGGCCCCGTCAGTCTTCCTCTTCCCCCC AAAACCCAAGGACACCCTCATGATCTCCCGGACCCCTGAGGTCACAT GCGTGGTGGTGGACGTGAGCCACGAAGACCCTGAGGTCAAGTTCAAC TGGTACGTGGACGGCGTGGAGGTGCATAATGCCAAGACAAAGCCGCG GGAGGAGCAGTACAACAGCACGTACCGTGTGGTCAGCGTCCTCACCG TCCTGCACCAGGACTGGCTGAATGGCAAGGAGTACAAGTGCAAGGTC TCCAACAAAGCCCTCCCAGCCCCCATCGAGAAAACCATCTCCAAAGC CAAAGGGCAGCCCCGAGAACCACAGGTGTACACCCTGCCCCCATCCC GGGAGGAGATGACCAAGAACCAGGTCAGCCTGACCTGCCTGGTCAAA GGCTTCTATCCCAGCGACATCGCCGTGGAGTGGGAGAGCAATGGGCA GCCGGAGAACAACTACAAGACCACGCCTCCCGTGCTGGACTCCGACG GCTCCTTCTTCCTCTATAGCAAGCTCACCGTGGACAAGAGCAGGTGG CAGCAGGGGAACGTCTTCTCATGCTCCGTGATGCATGAGGCTCTGCA CAACCACTACACGCAGAAGAGCCTCTCCCTGTCCCCGGGTTGA |
| 534 | P1-72006 (P1-061029_Y32E) LC DNA | GAAATTGTGTTGACGCAGTCTCCAGGCACCCTGTCTTTGTCTCCAGG GGAAAGAGCCACCCTCTCCTGCAGGGCCAGTCAGAGTGTTAGCAGCA GCTACTTAGCCTGGTACCAGCAGAAACCTGGCCAGGCTCCCAGGCTC CTCATCTATGGTGCATCCAGCAGGGCCACTGGCATCCCAGACAGGTT CAGTGGCAGTGGGTCTGGGACAGACTTCACTCTCACCATCAGCAGAC TGGAGCCTGAAGATTTTGCAGTGTATTACTGTCAGCAGTATGGTAGC TCACCATTCACTTTCGGCCCTGGGACCAAAGTGGATATCAAACGTAC GGTGGCTGCACCATCTGTCTTCATCTTCCCGCCATCTGATGAGCAGT TGAAATCTGGAACTGCCTCTGTTGTGTGCCTGCTGAATAACTTCTAT CCCAGAGAGGCCAAAGTACAGTGGAAGGTGGATAACGCCCTCCAATC GGGTAACTCCCAGGAGAGTGTCACAGAGCAGGACAGCAAGGACAGCA CCTACAGCCTCAGCAGCACCCTGACGCTGAGCAAAGCAGACTACGAG AAACACAAAGTCTACGCCTGCGAAGTCACCCATCAGGGCCTGAGCTC GCCCGTCACAAAGAGCTTCAACAGGGGAGAGTGTTAG |
| 535 | P1-72006 (P1-061029_Y32E) VH K16R T84A | EVQLVESGGGLVQPGRSLRLSCAASGFTLDDEAMHWVRQAPGKGLEW VSGINWNSANIGYADSVKGRFTISRDNAKNSLYLQMNSLRAEDTALY YCAKVPGYSGGWIDAFDVWGQGTMVTVSS |
| 536 | P1-72006 (P1-061029_Y32E) VH K16R | EVQLVESGGGLVQPGRSLRLSCAASGFTLDDEAMHWVRQAPGKGLEW VSGINWNSANIGYADSVKGRFTISRDNAKNSLYLQMNSLRTEDTALY YCAKVPGYSGGWIDAFDVWGQGTMVTVSS |
| 537 | P1-72006 (P1-061029_Y32E) VH T84A | EVQLVESGGGLVQPGKSLRLSCAASGFTLDDEAMHWVRQAPGKGLEW VSGINWNSANIGYADSVKGRFTISRDNAKNSLYLQMNSLRAEDTALY YCAKVPGYSGGWIDAFDVWGQGTMVTVSS |
| 538 | P1-72006 (P1-061029_Y32E) VH K16R T84A DNA | GAGGTGCAGCTGGTGGAGTCTGGGGGAGGCTTGGTACAGCCTGGCAg GTCCCTGAGACTCTCCTGTGCAGCCTCTGGATTCACCCTTGATGATG AGGCCATGCACTGGGTCCGGCAAGCTCCAGGGAAGGGCCTGGAGTGG GTCTCAGGTATTAATTGGAACAGTGCTAACATAGGCTATGCGGACTC TGTGAAGGGCCGATTCACCATCTCCAGAGACAACGCCAAGAACTCCC TGTATCTGCAAATGAACAGTCTGAGAgCTGAGGACACGGCCTTGTAT TACTGTGCAAAAGTTCCTGGGTATAGCGGTGGCTGGATTGACGCTTT TGATGTCTGGGGCCAAGGGACAATGGTCACCGTCTCTTCA |
| 539 | P1-72008 (P1-061029_Y32E_F100f E) VH | EVQLVESGGGLVQPGKSLRLSCAASGFTLDDEAMHWVRQAPGKGLEW VSGINWNSANIGYADSVKGRFTISRDNAKNSLYLQMNSLRTEDTALY YCAKVPGYSGGWIDAEDVWGQGTMVTVSS |
| 540 | P1-72008 (P1-061029 Y32E_F100fE) VL | EIVLTQSPGTLSLSPGERATLSCRASQSVSSSYLAWYQQKPGQAPRL LIYGASSRATGIPDRFSGSGSGTDFTLTISRLEPEDFAVYYCQQYGS SPFTFGPGTKVDIK |
| 541 | P1-72008 (P1-061029_Y32E_F100fE) HC | EVQLVESGGGLVQPGKSLRLSCAASGFTLDDEAMHWVRQAPGKGLEW VSGINWNSANIGYADSVKGRFTISRDNAKNSLYLQMNSLRTEDTALY YCAKVPGYSGGWIDAEDVWGQGTMVTVSSASTKGPSVFPLAPSSKST SGGTAALGCLVKDYFPEPVTVSWNSGALTSGVHTFPAVLQSSGLYSL SSVVTVPSSSLGTQTYICNVNHKPSNTKVDKRVEPKSCDKTHTCPPC PAPEAEGAPSVFLFPPKPKDTLMISRTPEVTCVVVDVSHEDPEVKFN WYVDGVEVHNAKTKPREEQYNSTYRVVSVLTVLHQDWLNGKEYKCKV SNKALPAPIEKTISKAKGQPREPQVYTLPPSREEMTKNQVSLTCLVK GFYPSDIAVEWESNGQPENNYKTTPPVLDSDGSFFLYSKLTVDKSRW QQGNVFSCSVMHEALHNHYTQKSLSLSPG |

| SEQ ID NO | Name | Sequence |
|---|---|---|
| 542 | P1-72008 (P1-061029_Y32E_F100fE) LC | EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| 543 | P1-72008 (P1-061029_Y32E_F100fE) VH DNA | GAGGTGCAGCTGGTGGAGTCTGGGGGAGGCTTGGTACAGCCTGGCAAGTCCCTGAGACTCTCCTGTGCAGCCTCTGGATTCACCCTTGATGATGAGGCCATGCACTGGGTCCGGCAAGCTCCAGGGAAGGGCCTGGAGTGGGTCTCAGGTATTAATTGGAACAGTGCTAACATAGGCTATGCGGACTCTGTGAAGGGCCGATTCACCATCTCCAGAGACAACGCCAAGAACTCCCTGTATCTGCAAATGAACAGTCTGAGAACTGAGGACACGGCCTTGTATTACTGTGCAAAAGTTCCTGGGTATAGCGGTGGCTGGATTGACGCTGAGGATGTCTGGGGCCAAGGGACAATGGTCACCGTCTCTTCA |
| 544 | P1-72008 (P1-61029_Y32E_F100fE) VL DNA | GAAATTGTGTTGACGCAGTCTCCAGGCACCCTGTCTTTGTCTCCAGGGGAAAGAGCCACCCTCTCCTGCAGGGCCAGTCAGAGTGTTAGCAGCAGCTACTTAGCCTGGTACCAGCAGAAACCTGGCCAGGCTCCCAGGCTCCTCATCTATGGTGCATCCAGCAGGGCCACTGGCATCCCAGACAGGTTCAGTGGCAGTGGGTCTGGGACAGACTTCACTCTCACCATCAGCAGACTGGAGCCTGAAGATTTTGCAGTGTATTACTGTCAGCAGTATGGTAGCTCACCATTCACTTTCGGCCCTGGGACCAAAGTGGATATCAAA |
| 545 | P1-72008 (P1-061029_Y32E_F100fE) HC DNA | GAGGTGCAGCTGGTGGAGTCTGGGGGAGGCTTGGTACAGCCTGGCAAGTCCCTGAGACTCTCCTGTGCAGCCTCTGGATTCACCCTTGATGATGAGGCCATGCACTGGGTCCGGCAAGCTCCAGGGAAGGGCCTGGAGTGGGTCTCAGGTATTAATTGGAACAGTGCTAACATAGGCTATGCGGACTCTGTGAAGGGCCGATTCACCATCTCCAGAGACAACGCCAAGAACTCCCTGTATCTGCAAATGAACAGTCTGAGAACTGAGGACACGGCCTTGTATTACTGTGCAAAAGTTCCTGGGTATAGCGGTGGCTGGATTGACGCTGAGGATGTCTGGGGCCAAGGGACAATGGTCACCGTCTCTTCAGCGTCGACCAAGGGCCCATCGGTCTTCCCCCTGGCACCCTCCTCCAAGAGCACCTCTGGGGGCACAGCGGCCCTGGGCTGCCTGGTCAAGGACTACTTCCCCGAACCGGTGACGGTGTCGTGGAACTCAGGCGCCCTGACCAGCGGCGTGCACACCTTCCCGGCTGTCCTACAGTCCTCAGGACTCTACTCCCTCAGCAGCGTGGTGACCGTGCCCTCCAGCAGCTTGGGCACCCAGACCTACATCTGCAACGTGAATCACAAGCCCAGCAACACCAAGGTGGACAAGAGAGTTGAGCCCAAATCTTGTGACAAAACTCACACATGCCCACCGTGCCCAGCACCTGAAGCCGAAGGGGCCCCGTCAGTCTTCCTCTTCCCCCCAAAACCCAAGGACACCCTCATGATCTCCCGGACCCCTGAGGTCACATGCGTGGTGGTGGACGTGAGCCACGAAGACCCTGAGGTCAAGTTCAACTGGTACGTGGACGGCGTGGAGGTGCATAATGCCAAGACAAAGCCGCGGGAGGAGCAGTACAACAGCACGTACCGTGTGGTCAGCGTCCTCACCGTCCTGCACCAGGACTGGCTGAATGGCAAGGAGTACAAGTGCAAGGTCTCCAACAAAGCCCTCCCAGCCCCCATCGAGAAAACCATCTCCAAAGCCAAAGGGCAGCCCCGAGAACCACAGGTGTACACCCTGCCCCCATCCCGGGAGGAGATGACCAAGAACCAGGTCAGCCTGACCTGCCTGGTCAAAGGCTTCTATCCCAGCGACATCGCCGTGGAGTGGGAGAGCAATGGGCAGCCGGAGAACAACTACAAGACCACGCCTCCCGTGCTGGACTCCGACGGCTCCTTCTTCCTCTATAGCAAGCTCACCGTGGACAAGAGCAGGTGGCAGCAGGGGAACGTCTTCTCATGCTCCGTGATGCATGAGGCTCTGCACAACCACTACACGCAGAAGAGCCTCTCCCTGTCCCCGGGTTGA |
| 546 | P1-72008 (P1-061029_Y32E_F100fE) LC DNA | GAAATTGTGTTGACGCAGTCTCCAGGCACCCTGTCTTTGTCTCCAGGGGAAAGAGCCACCCTCTCCTGCAGGGCCAGTCAGAGTGTTAGCAGCAGCTACTTAGCCTGGTACCAGCAGAAACCTGGCCAGGCTCCCAGGCTCCTCATCTATGGTGCATCCAGCAGGGCCACTGGCATCCCAGACAGGTTCAGTGGCAGTGGGTCTGGGACAGACTTCACTCTCACCATCAGCAGACTGGAGCCTGAAGATTTTGCAGTGTATTACTGTCAGCAGTATGGTAGCTCACCATTCACTTTCGGCCCTGGGACCAAAGTGGATATCAAACGTACGGTGGCTGCACCATCTGTCTTCATCTTCCCGCCATCTGATGAGCAGTTGAAATCTGGAACTGCCTCTGTTGTGTGCCTGCTGAATAACTTCTATCCCAGAGAGGCCAAAGTACAGTGGAAGGTGGATAACGCCCTCCAATCGGGTAACTCCCAGGAGAGTGTCACAGAGCAGGACAGCAAGGACAGCACCTACAGCCTCAGCAGCACCCTGACGCTGAGCAAAGCAGACTACGAGAAACACAAAGTCTACGCCTGCGAAGTCACCCATCAGGGCCTGAGCTCGCCCGTCACAAAGAGCTTCAACAGGGGAGAGTGTTAG |
| 547 | P1-72008 (P1-061029_Y32E_F100fE) VH K16R T84A | EVQLVESGGGLVQPGRSLRLSCAASGFTLDDEAMHWVRQAPGKGLEWVSGINWNSANIGYADSVKGRFTISRDNAKNSLYLQMNSLRAEDTALYYCAKVPGYSGGWIDAEDVWGQGTMVTVSS |
| 548 | P1-72008 (P1-061029_Y32E_F100fE) VH K16R | EVQLVESGGGLVQPGRSLRLSCAASGFTLDDEAMHWVRQAPGKGLEWVSGINWNSANIGYADSVKGRFTISRDNAKNSLYLQMNSLRTEDTALYYCAKVPGYSGGWIDAEDVWGQGTMVTVSS |
| 549 | P1-72008 (P1-061029_Y32E_F100fE) Y32E_100fE) VH T84A | EVQLVESGGGLVQPGKSLRLSCAASGFTLDDEAMHWVRQAPGKGLEWVSGINWNSANIGYADSVKGRFTISRDNAKNSLYLQMNSLRAEDTALYYCAKVPGYSGGWIDAEDVWGQGTMVTVSS |

| SEQ ID NO | Name | Sequence |
|---|---|---|
| 550 | P1-72008 (P1-061029_Y32D_F100fE) VH K16R T84A DNA | GAGGTGCAGCTGGTGGAGTCTGGGGGAGGCTTGGTACAGCCTGGCAg GTCCCTGAGACTCTCCTGTGCAGCCTCTGGATTCACCCTTGATGATG AGGCCATGCACTGGGTCCGGCAAGCTCCAGGGAAGGGCCTGGAGTGG GTCTCAGGTATTAATTGGAACAGTGCTAACATAGGCTATGCGGACTC TGTGAAGGGCCGATTCACCATCTCCAGAGACAACGCCAAGAACTCCC TGTATCTGCAAATGAACAGTCTGAGAgCTGAGGACACGGCCTTGTAT TACTGTGCAAAAGTTCCTGGGTATAGCGGTGGCTGGATTGACGCTGA GGATGTCTGGGGCCAAGGGACAATGGTCACCGTCTCTTCA |
| 551 | VISTA.4 VH 41F11 With signal sequence, which is underlined | MEFGLSWVFLVAIIKGVQCQVQLVESGGGLVKPGGSLRLSCAASGFT FSDYYMSWIRQAPGKGLEWVSYISNSGSPIYYADSVKGRFTISRDNA KNSLYLQMNSLRAEDTAVYYCARDLPGWYFDLWGRGTLVTVSS |
| 552 | VISTA.4 VK1 VL 41F11 With signal sequence, which is underlined | MEAPAQLLFLLLLWLPDTTGEIVLTQSPATLSLSPGERATLSCRASQ SVSSYLAWYQQKPGQAPRLLIYDASNRATGIPARFSASGSGTDFTLT ISSLEPEDFAVYYCQQRNNWPRTFGQGTKVEIK |
| 553 | VISTA.4 VK2 VL 41F11 With signal sequence, which is underlined | MDMRVLAQLLGLLLLCFPGARCDIQMTQSPSSLSASVGDRVTITCRA SQGISSWLAWYQQKPEKAPKSLIYAASSLQSGVPSRFSGSGSGTDFT LTISSLQPEDFATYYCQQYNSYPRTFGQGTKVEIK |
| 554 | VISTA.4 VK3 VL 41F11 With signal sequence, which is underlined | METPAQLLFLLLLWLPDTTGEIVLTQSPGTLSLSPGERATLSCRASQ SVSSSYLAWYQQKPGQAPRLLIYGASSRATGIPDRFSGSGSGTDFTL TISRLEPEDFAVYYCQQYGSSPWTFGQGTKVEIK |
| 555 | VISTA.4 VH DNA 41F11 With signal sequence, which is underlined | ATGGAGTTTGGGCTGAGCTGGGTTTTCCTTGTTGCTATTATAAAGG TGTCCAGTGTCAGGTGCAGTTGGTGGAGTCTGGGGGAGGCTTGGTCA AGCCTGGAGGGTCCCTGAGACTCTCCTGTGCAGCCTCTGGATTCACC TTCAGTGACTATTACATGAGCTGGATCCGCCAGGCTCCAGGGAAGGG GCTGGAGTGGGTTTCATACATTAGTAATAGTGGTAGTCCCATATACT ACGCAGACTCTGTGAAGGGCCGATTCACCATCTCCAGGGACAACGCC AAGAACTCACTGTATCTGCAAATGAACAGCCTGAGAGCCGAGGACAC GGCCGTGTATTACTGTGCGAGAGATCTCCCCGGGCTGGTACTTCGATC TCTGGGGCCGTGGCACCCTGGTCACTGTCTCCTCA |
| 556 | VISTA.4 VK1 VL DNA With signal sequence, which is underlined | ATGGAAGCCCCAGCTCAGCTTCTCTTCCTCCTGCTACTCTGGCTCCC AGATACCACCGGAGAAATTGTGTTGACAGTCTCCAGCCACCCTGT CTTTGTCTCCAGGGGAAAGAGCCACCCTCTCCTGCAGGGCCAGTCAG AGTGTTAGCAGCTACTTAGCCTGGTACCAACAGAAACCTGGCCAGGC TCCCAGGCTCCTCATCTATGATGCATCCAACAGGGCCACTGGCATCC CAGCCAGGTTCAGTGCCAGTGGGTCTGGGACAGACTTCACTCTCACC ATCAGCAGCCTAGAGCCTGAAGATTTTGCAGTTTATTACTGTCAGCA GCGTAACAACTGGCCTCGGACGTTCGGCCAAGGGACCAAGGTGGAAA TCAAA |
| 557 | VISTA.4.A64G VK1 VL With signal sequence, which is underlined | MEAPAQLLFLLLLWLPDTTGEIVLTQSPATLSLSPGERATLSCRASQ SVSSYLAWYQQKPGQAPRLLIYDASNRATGIPARFSGSGSGTDFTLT ISSLEPEDFAVYYCQQRNNWPRTFGQGTKVEIK |
| 558 | VISTA.4.A64G LC With signal sequence, which is underlined | MEAPAQLLFLLLLWLPDTTGEIVLTQSPATLSLSPGERATLSCRASQ SVSSYLAWYQQKPGQAPRLLIYDASNRATGIPARFSGSGSGTDFTLT ISSLEPEDFAVYYCQQRNNWPRTFGQGTKVEIKRTVAAPSVFIFPPS DEQLKSGTASVVCLLNNFYPREAKVQWKVDNALQSGNSQESVTEQDS KDSTYSLSSTLTLSKADYEKHKVYACEVTHQGLSSPVTKSFNRGEC |
| 559 | VISTA.5 VH | AVQLQESGPGLVRPSQSLSLTCTVTDYSITSDYAWNWIRQFPGSKLE WLGFIGYSGNTNYNPSLESRISITRHTSKNQFFLHLNSMTTEDTATY YCARSLYGGSHWYFDVWGAGTTVTVSS |
| 560 | VISTA.5 VK1, VL | DIVLTQSPASLAVSLGQRATISCRGSESVEYYGTILMQWYQQKPGQP PKLLIYGASNVESGVPARFSGSGSGTDFSLNIHPVEEDDIAMYFCQQ SRKVPWTFGGGTKLEIK |
| 561 | VISTA.5 VH DNA | GCTGTGCAGCTTCAGGAGTCGGGACCTGGCCTGGTGAGACCTTCTCA GTCTCTGTCCCTCACCTGCACTGTCACTGACTACTCAATCACCAGTG ATTATGCCTGGAACTGGATCCGGCAGTTTCCAGGAAGCAAACTGGAG TGGCTGGGCTTCATAGGCTACAGTGGTAACACTAACTACAACCCATC TCTCGAAAGTCGAATCTCTATCACTCGACACACATCCAAGAACCAGT TCTTCCTGCACTTGAATTCTATGACTACTGAGGACACAGCCACATAT TACTGTGCAAGATCCCTCTACGGTGGTAGTCACTGGTACTTCGATGT CTGGGGCGCAGGGACCACGGTCACCGTCTCCTCA |
| 562 | VISTA.5 VK1, VL DNA | GACATTGTGCTCACCCAATCTCCAGCTTCTTTGGCTGTGTCTCTAGG GCAGAGAGCCACCATCTCCTGCAGAGGCAGTGAAAGTGTTGAATATT ATGGCACAATTTTAATGCAGTGGTACCAACAGAAACCAGGACAGCCA CCCAAACTCCTCATCTATGGTGCATCCAACGTAGAATCTGGGGTCCC TGCCAGGTTTAGTGGCAGTGGGTCTGGGACAGACTTCAGCCTCAACA |

| SEQ ID NO | Name | Sequence |
|---|---|---|
| | | TCCATCCTGTGGAGGAGGATGATATTGCAATGTATTTCTGTCAGCAA AGTAGGAAGGTTCCGTGGACGTTCGGTGGAGGCACCAAGCTGGAAAT CAAA |

SEQUENCE LISTING (568 sequences)

SEQ ID NO: 1 - protein, 311 aa, Homo sapiens
  misc_feature (1)..(311): hVISTA (with leader sequence)
MGVPTALEAGSWRWGSLLFALFLAASLGPVAAFKVATPYSLYVCPEGQNVTLTCRLLGPVDKGHDVTFYKTWYRSSRGEVQTCSERRPIRNLTFQDLHLHHGGHQAANTSHDLAQRHGLESASDHHGNFSITMRNLTLLDSGLYCCLVVEIRHHHSEHRVHGAMELQVQTGKDAPSNCVVYPSSSQDSENITAAALATGACIVGILCLPLILLLVYKQRQAASNRRAQELVRMDSNIQGIENPGFEASPPAQGIPEAKVRHPLSYVAQRQPSESGRHLLSEPSTPLSPPGPGDVFFPSLDPVPDSPNFEVI

SEQ ID NO: 2 - protein, 279 aa, Homo sapiens
  misc_feature (1)..(279): hVISTA (no leader sequence)
  misc_feature (155)..(155): X is D or E
FKVATPYSLYVCPEGQNVTLTCRLLGPVDKGHDVTFYKTWYRSSRGEVQTCSERRPIRNLTFQDLHLHHGGHQAANTSHDLAQRHGLESASDHHGNFSITMRNLTLLDSGLYCCLVVEIRHHHSEHRVHGAMELQVQTGKDAPSNCVVYPSSSQXSENITAAALATGACIVGILCLPLILLLVYKQRQAASNRRAQELVRMDSNIQGIENPGFEASPPAQGIPEAKVRHPLSYVAQRQPSESGRHLLSEPSTPLSPPGPGDVFFPSLDPVPDSPNFEVI

SEQ ID NO: 3 - protein, 412 aa, Homo sapiens
  misc_feature (1)..(412): Human PSGL-1 isoform 2 precursor, with signal peptide
MPLQLLLLLILLGPGNSLQLWDTWADEAEKALGPLLARDRRQATEYEYLDYDFLPETEPPEMLRNSTDTTPLTGPGTPESTTVEPAARRSTGLDAGGAVTELTTELANMGNLSTDSAAMEIQTTQPAATEAQTTQPVPTEAQTTPLAATEAQTTRLTATEAQTTPLAATEAQTTPPAATEAQTTQPTGLEAQTTAPAAMEAQTTAPAAMEAQTTPPAAMEAQTTQTTAMEAQTTAPEATEAQTTQPTATEAQTTPLAAMEALSTEPSATEALSMEPTTKRGLFIPFSVSSVTHKGIPMAASNLSVNYPVGAPDHISVKQCLLAILILALVATIFFVCTVVLAVRLSRKGHMYPVRNYSPTEMVCISSLLPDGGEGPSATANGGLSKAKSPGLTPEPREDREGDDLTLHSFLP

SEQ ID NO: 4 - protein, 395 aa, Homo sapiens
  misc_feature (1)..(395): Human PSGL-1 isoform 2, without signal peptide
LQLWDTWADEAEKALGPLLARDRRQATEYEYLDYDFLPETEPPEMLRNSTDTTPLTGPGTPESTTVEPAARRSTGLDAGGAVTELTTELANMGNLSTDSAAMEIQTTQPAATEAQTTQPVPTEAQTTPLAATEAQTTRLTATEAQTTPLAATEAQTTPPAATEAQTTQPTGLEAQTTAPAAMEAQTTAPAAMEAQTTPPAAMEAQTTQTTAMEAQTTAPEATEAQTTQPTATEAQTTPLAAMEALSTEPSATEALSMEPTTKRGLFIPFSVSSVTHKGIPMAASNLSVNYPVGAPDHISVKQCLLAILILALVATIFFVCTVVLAVRLSRKGHMYPVRNYSPTEMVCISSLLPDGGEGPSATANGGLSKAKSPGLTPEPREDREGDDLTLHSFLP

SEQ ID NO: 5 - protein, 226 aa, Homo sapiens
  misc_feature (1)..(226): Human PSGL-1 isoform 2 ECD, with signal peptide
MPLQLLLLLILLGPGNSLQLWDTWADEAEKALGPLLARDRRQATEYEYLDYDFLPETEPPEMLRNSTDTTPLTGPGTPESTTVEPAARRSTGLDAGGAVTELTTELANMGNLSTDSAAMEIQTTQPAATEAQTTQPVPTEAQTTPLAATEAQTTRLTATEAQTTPLAATEAQTTPPAATEAQTTQPTGLEAQTTAPAAMEAQTTAPAAMEAQTTPPAAMEAQTTQT

SEQ ID NO: 6 - protein, 209 aa, Homo sapiens
  misc_feature (1)..(209): Human PSGL-1 isoform 2 ECD, without signal peptide
LQLWDTWADEAEKALGPLLARDRRQATEYEYLDYDFLPETEPPEMLRNSTDTTPLTGPGTPESTTVEPAARRSTGLDAGGAVTELTTELANMGNLSTDSAAMEIQTTQPAATEAQTTQPVPTEAQTTPLAATEAQTTRLTATEAQTTPLAATEAQTTPPAATEAQTTQPTGLEAQTTAPAAMEAQTTAPAAMEAQTTPPAAMEAQTTQT

SEQ ID NO: 7 - protein, 254 aa, Homo sapiens
  misc_feature (1)..(254): Human PSGL-1 ECD (N-terminal positions 42 to 295 of a full length Human PSGL-1 )
QATEYEYLDYDFLPETEPPEMLRNSTDTTPLTGPGTPESTTVEPAARRSTGLDAGGAVTELTTELANMGNLSTDSAAMEIQTTQPAATEAQTTPLAATEAQTTRLTATEAQTTPLAATEAQTTPPAATEAQTTQPTGLEAQTTAPAAMEAQTTAPAAMEAQTTPPAAMEAQTTQTTAMEAQTTAPEATEAQTTQPTATEAQTTPLAAMEALSTEPSATEALSMEPTTKRGLFIPFSVSSVTHKGIPMAASNLSV

SEQ ID NO: 8 - protein, 428 aa, Homo sapiens
  misc_feature (1)..(428): HumPSGL-1 isoform 1 precursor, with signal peptide
MAVGASGLEGDKMAGAMPLQLLLLLILLGPGNSLQLWDTWADEAEKALGPLLARDRRQATEYEYLDYDFLPETEPPEMLRNSTDTTPLTGPGTPESTTVEPAARRSTGLDAGGAVTELTTELANMGNLSTDSAAMEIQTTQPAATEAQTTQPVPTEAQTTPLAATEAQTTRLTATEAQTTPLAATEAQTTPPAATEAQTTQPTGLEAQTTAPAAMEAQTTAPAAMEAQTTPPAAMEAQTTQTTAMEAQTTAPEATEAQTTQPTATEAQTTPLAAMEALSTEPSATEALSMEPTTKRGLFIPFSVSSVTHKGIPMAASNLSVNYPVGAPDHISVKQCLLAILILALVATIFFVCTVVLAVRLSRKGHMYPVRNYSPTEMVCISSLLPDGGEGPSATANGGLSKAKSPGLTPEPREDREGDDLTLHSFLP

SEQ ID NO: 9 - protein, 395 aa, Homo sapiens; identical to SEQ ID NO: 4
  misc_feature (1)..(395): Human PSGL-1, without signal peptide

SEQ ID NO: 10 - protein, 242 aa, Homo sapiens
  misc_feature (1)..(242): Human PSGL-1 ECD, with signal peptide
MAVGASGLEGDKMAGAMPLQLLLLLILLGPGNSLQLWDTWADEAEKALGPLLARDRRQATEYEYLDYDFLPETEPPEMLRNSTDTTPLTGPGTPESTTVEPAARRSTGLDAGGAVTELTTELANMGNLSTDSAAMEIQTTQPAATEAQTTQPVPTEAQTTPLAATEAQTTRLTATEAQTTPLAATEAQTTPPAATEAQTTQPTGLEAQTTAPAAMEAQTTAPAAMEAQTTPPAAMEAQTTQT

SEQ ID NO: 11 - protein, 123 aa, Artificial Sequence
  Synthetic: P1-069059 VH
EVQLVESGGGLVQPGKSLRLSCAASGFTLEDYAMHWVRQAPGKGLEWVSGINWNSDHIGYADSVKGRFTISRDNAKNSLYLQMNSLRTEDTALYYCAKVPGYSGGWIDAEDDWGQGTMVTVSS

SEQ ID NO: 12 - protein, 108 aa, Artificial Sequence
  Synthetic: P1-069059 VL
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTKVDIK

SEQ ID NO: 13 - protein, 452 aa, Artificial Sequence
  Synthetic: P1-069059 IgG1.3 HC
EVQLVESGGGLVQPGKSLRLSCAASGFTLEDYAMHWVRQAPGKGLEWVSGINWNSDHIGYADSVKGRFTISRDNAKNSLYLQMNSLRTEDTALYYCAKVPGYSGGWIDAEDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 14 - protein, 215 aa, Artificial Sequence
  Synthetic: P1-069059 LC
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15 - protein, 123 aa, Artificial Sequence
  Synthetic: P1-069061 VH
EVQLVESGGGLVQPGKSLRLSCAASGFTLEDYAMHWVRQAPGKGLEWVSGINWNSAEIGYADSVKGRFTISRDNAKNSLYLQMNSLRTEDTALYYCAKVPGYSGGWIDAEDDWGQGTMVTVSS

SEQ ID NO: 16 - protein, 108 aa, Artificial Sequence; identical to SEQ ID NO: 12
  Synthetic: P1-069061 VL

SEQ ID NO: 17 - protein, 452 aa, Artificial Sequence
  Synthetic: P1-069061 IgG1.3 HC
EVQLVESGGGLVQPGKSLRLSCAASGFTLEDYAMHWVRQAPGKGLEWVSGINWNSAEIGYADSVKGRFTISRDNAKNSLYLQMNSLRTEDTALYYCAKVPGYSGGWIDAEDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 18 - protein, 215 aa, Artificial Sequence; identical to SEQ ID NO: 14
  Synthetic: P1-069061 LC

SEQ ID NO: 19 - protein, 123 aa, Artificial Sequence
  Synthetic: P1-069063 VH
EVQLVESGGGLVQPGKSLRLSCAASGFTLEDYAMHWVRQAPGKGLEWVSGINWNSAEIGYADSVKGRFTISRDNAKNSLYLQMNSLRTEDTALYYCAKVPGYSGGWIDADDEWGQGTMVTVSS

SEQ ID NO: 20 - protein, 108 aa, Artificial Sequence; identical to SEQ ID NO: 12
  Synthetic: P1-069063 VL

SEQ ID NO: 21 - protein, 452 aa, Artificial Sequence
  Synthetic: P1-069063 IgG1.3 HC
EVQLVESGGGLVQPGKSLRLSCAASGFTLEDYAMHWVRQAPGKGLEWVSGINWNSAEIGYADSVKGRFTISRDNAKNSLYLQMNSLRTEDTALYYCAKVPGYSGGWIDADDEWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 22 - protein, 215 aa, Artificial Sequence; identical to SEQ ID NO: 14
  Synthetic: P1-069063 LC

SEQ ID NO: 23 - protein, 123 aa, Artificial Sequence
  Synthetic: P1-069065 VH
EVQLVESGGGLVQPGKSLRLSCAASGFTLEDEAMHWVRQAPGKGLEWVSGINWNSDDIGYADSVKGRFTISRDNAKNSLYLQMNSLRTEDTALYYCAKVPGYSGGWIDAFDVWGQGTMVTVSS

SEQ ID NO: 24 - protein, 108 aa, Artificial Sequence; identical to SEQ ID NO: 12
  Synthetic: P1-069065 VL

SEQ ID NO: 25 - protein, 452 aa, Artificial Sequence
  Synthetic: P1-069065 IgG1.3 HC
EVQLVESGGGLVQPGKSLRLSCAASGFTLEDEAMHWVRQAPGKGLEWVSGINWNSDDIGYADSVKGRFTISRDNAKNSLYLQMNSLRTEDTALYYCAKVPGYSGGWIDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 26 - protein, 215 aa, Artificial Sequence; identical to SEQ ID NO: 14
  Synthetic: P1-069065 LC

SEQ ID NO: 27 - protein, 123 aa, Artificial Sequence
  Synthetic: P1-069067 VH
EVQLVESGGGLVQPGKSLRLSCAASGFTLDDYAMHWVRQAPGKGLEWVSGINWNSEEIGYADSVKGRFTISRDNAKNSLYLQMNSLRTEDTALYYCAKVPGYSGGWIDADDEWGQGTMVTVSS

SEQ ID NO: 28 - protein, 108 aa, Artificial Sequence; identical to SEQ ID NO: 12
  Synthetic: P1-069067 VL

SEQ ID NO: 29 - protein, 452 aa, Artificial Sequence
  Synthetic: P1-069067 IgG1.3 HC
EVQLVESGGGLVQPGKSLRLSCAASGFTLDDYAMHWVRQAPGKGLEWVSGINWNSEEIGYADSVKGRFTISRDNAKNSLYLQMNSLRTEDTALYYCAKVPGYSGGWIDADDEWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 30 - protein, 215 aa, Artificial Sequence; identical to SEQ ID NO: 14
  Synthetic: P1-069067 LC

SEQ ID NO: 31 - protein, 123 aa, Artificial Sequence
  Synthetic: P1-069069 VH
EVQLVESGGGLVQPGKSLRLSCAASGFTLDDYAMHWVRQAPGKGLEWVSGINWNSEEIGYADSVKGRFTISRDNAKNSLYLQMNSLRTEDTALYYCAKVPGYSGGWIDADDVWGQGTMVTVSS

SEQ ID NO: 32 - protein, 108 aa, Artificial Sequence; identical to SEQ ID NO: 12
  Synthetic: P1-069069 VL

SEQ ID NO: 33 - protein, 452 aa, Artificial Sequence
  Synthetic: P1-069069 IgG1.3 HC
EVQLVESGGGLVQPGKSLRLSCAASGFTLDDYAMHWVRQAPGKGLEWVSGINWNSEEIGYADSVKGRFTISRDNAKNSLYLQMNSLRTEDTALYYCAKVPGYSGGWIDADDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 34 - protein, 215 aa, Artificial Sequence; identical to SEQ ID NO: 14
  Synthetic: P1-069069 LC

SEQ ID NO: 35 - protein, 123 aa, Artificial Sequence
  Synthetic: P1-069071 VH
EVQLVESGGGLVQPGKSLRLSCAASGFTLEDEAMHWVRQAPGKGLEWVSGINWNSADIGYADSVKGRFTISRDNAKNSLYLQMNSLRTEDTALYYCAKVPGYSEGWIDAFDVWGQGTMVTVSS

SEQ ID NO: 36 - protein, 108 aa, Artificial Sequence; identical to SEQ ID NO: 12
  Synthetic: P1-069071 VL

SEQ ID NO: 37 - protein, 452 aa, Artificial Sequence
  Synthetic: P1-069071 IgG1.3 HC
EVQLVESGGGLVQPGKSLRLSCAASGFTLEDEAMHWVRQAPGKGLEWVSGINWNSADIGYADSVKGRFTISRDNAKNSLYLQMNSLRTEDTALYYCAKVPGYSEGWIDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 38 - protein, 215 aa, Artificial Sequence; identical to SEQ ID NO: 14
  Synthetic: P1-069071 LC

SEQ ID NO: 39 - protein, 123 aa, Artificial Sequence
  Synthetic: P1-069073 VH
EVQLVESGGGLVQPGKSLRLSCAASGFTLEDEAMHWVRQAPGKGLEWVSGINWNSAEIGYADSVKGRFTISRDNAKNSLYLQMNSLRTEDTALYYCAKVPGYSGGWIDAEDVWGQGTMVTVSS

SEQ ID NO: 40 - protein, 108 aa, Artificial Sequence; identical to SEQ ID NO: 12
  Synthetic: P1-069073 VL

SEQ ID NO: 41 - protein, 452 aa, Artificial Sequence
  Synthetic: P1-069073 IgG1.3 HC
EVQLVESGGGLVQPGKSLRLSCAASGFTLEDEAMHWVRQAPGKGLEWVSGINWNSAEIGYADSVKGRFTISRDNAKNSLYLQMNSLRTEDTALYYCAKVPGYSGGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 42 - protein, 215 aa, Artificial Sequence; identical to SEQ ID NO: 14
  Synthetic: P1-069073 LC

SEQ ID NO: 43 - protein, 123 aa, Artificial Sequence
  Synthetic: P1-069075 VH
EVQLVESGGGLVQPGKSLRLSCAASGFTLEDYAMHWVRQAPGKGLEWVSGINWDSAEIGYADSVKGRFTISRDNAKNSLYLQMNSLRTEDTALYYCAKVPGYSHGWIDAEDVWGQGTMVTVSS

SEQ ID NO: 44 - protein, 108 aa, Artificial Sequence; identical to SEQ ID NO: 12
  Synthetic: P1-069075 VL

SEQ ID NO: 45 - protein, 452 aa, Artificial Sequence
  Synthetic: P1-069075 IgG1.3 HC
EVQLVESGGGLVQPGKSLRLSCAASGFTLEDYAMHWVRQAPGKGLEWVSGINWDSAEIGYADSVKGRFTISRDNAKNSLYLQMNSLRTEDTALYYCAKVPGYSHGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 46 - protein, 215 aa, Artificial Sequence; identical to SEQ ID NO: 14
  Synthetic: P1-069075 LC

SEQ ID NO: 47 - protein, 123 aa, Artificial Sequence
  Synthetic: P1-069077 VH
EVQLVESGGGLVQPGKSLRLSCAASGFTLEDEAMHWVRQAPGKGLEWVSGINWNSDEIGYADSVKGRFTISRDNAKNSLYLQMNSLRTEDTALYYCAKVPGYSGGWIDAFDVWGQGTMVTVSS

SEQ ID NO: 48 - protein, 108 aa, Artificial Sequence; identical to SEQ ID NO: 12
  Synthetic: P1-069077 VL

SEQ ID NO: 49 - protein, 452 aa, Artificial Sequence
  Synthetic: P1-069077 IgG1.3 HC
EVQLVESGGGLVQPGKSLRLSCAASGFTLEDEAMHWVRQAPGKGLEWVSGINWNSDEIGYADSVKGRFTISRDNAKNSLYLQMNSLRTEDTALYYCAKVPGYSGGWIDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 50 - protein, 215 aa, Artificial Sequence; identical to SEQ ID NO: 14
  Synthetic: P1-069077 LC

SEQ ID NO: 51 - protein, 123 aa, Artificial Sequence
  Synthetic: P1-068761 VH
EVQLVESGGGLVQPGKSLRLSCAASGFTLEDEAMHWVRQAPGKGLEWVSGINWNSEEIGYADSVKGRFTISRDNAKNSLYLQMNSLRTEDTALYYCAKVPGYSHGWIDAEDVWGQGTMVTVSS

SEQ ID NO: 52 - protein, 108 aa, Artificial Sequence; identical to SEQ ID NO: 12
  Synthetic: P1-068761 VL

SEQ ID NO: 53 - protein, 452 aa, Artificial Sequence
  Synthetic: P1-068761 IgG1.3 HC
EVQLVESGGGLVQPGKSLRLSCAASGFTLEDEAMHWVRQAPGKGLEWVSGINWNSEEIGYADSVKGRFTISRDNAKNSLYLQMNSLRTEDTALYYCAKVPGYSHGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 54 - protein, 215 aa, Artificial Sequence; identical to SEQ ID NO: 14
  Synthetic: P1-068761 LC

SEQ ID NO: 55 - protein, 123 aa, Artificial Sequence
  Synthetic: P1-068767 VH
EVQLVESGGGLVQPGKSLRLSCAASGFTLEDYAMHWVRQAPGKGLEWVSGIDWNSENIGYADSVKGRFTISRDNAKNSLYLQMNSLRTEDTALYYCAKVPGYSGGWIDAEDDWGQGTMVTVSS

SEQ ID NO: 56 - protein, 108 aa, Artificial Sequence; identical to SEQ ID NO: 12
  Synthetic: P1-068767 VL

SEQ ID NO: 57 - protein, 452 aa, Artificial Sequence
  Synthetic: P1-068767 IgG1.3 HC
EVQLVESGGGLVQPGKSLRLSCAASGFTLEDYAMHWVRQAPGKGLEWVSGIDWNSENIGYADSVKGRFTISRDNAKNSLYLQMNSLRTEDTALYYCAKVPGYSGGWIDAEDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 58 - protein, 215 aa, Artificial Sequence; identical to SEQ ID NO: 14
  Synthetic: P1-068767 LC

SEQ ID NO: 59 - protein, 123 aa, Artificial Sequence
  Synthetic: P1-068773 VH
EVQLVESGGGLVQPGKSLRLSCAASGFTLEDYAMHWVRQAPGKGLEWVSGIDWNSDNIGYADSVKGRFTISRDNAKNSLYLQMNSLRTEDTALYYCAKVPGYSGGWIDAEDDWGQGTMVTVSS

SEQ ID NO: 60 - protein, 108 aa, Artificial Sequence; identical to SEQ ID NO: 12
  Synthetic: P1-068773 VL

SEQ ID NO: 61 - protein, 452 aa, Artificial Sequence
  Synthetic: P1-068773 IgG1.3 HC
EVQLVESGGGLVQPGKSLRLSCAASGFTLEDYAMHWVRQAPGKGLEWVSGIDWNSDNIGYADSVKGRFTISRDNAKNSLYLQMNSLRTEDTALYYCAKVPGYSGGWIDAEDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 62 - protein, 215 aa, Artificial Sequence; identical to SEQ ID NO: 14
  Synthetic: P1-068773 LC

SEQ ID NO: 63 - protein, 123 aa, Artificial Sequence
  Synthetic: P1-068765 VH
EVQLVESGGGLVQPGKSLRLSCAASGFTDEDYAMHWVRQAPGKGLEWVSGINWNSEEIGYADSVKGRFTISRDNAKNSLYLQMNSLRTEDTALYYCAKVPGYSGGWIDAEDDWGQGTMVTVSS

SEQ ID NO: 64 - protein, 108 aa, Artificial Sequence; identical to SEQ ID NO: 12
  Synthetic: P1-068765 VL

SEQ ID NO: 65 - protein, 452 aa, Artificial Sequence
  Synthetic: P1-068765 IgG1.3 HC
EVQLVESGGGLVQPGKSLRLSCAASGFTDEDYAMHWVRQAPGKGLEWVSGINWNSEEIGYADSVKGRFTISRDNAKNSLYLQMNSLRTEDTALYYCAKVPGYSGGWIDAEDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 66 - protein, 215 aa, Artificial Sequence; identical to SEQ ID NO: 14
  Synthetic: P1-068765 LC

SEQ ID NO: 67 - protein, 123 aa, Artificial Sequence
  Synthetic: P1-061029 VH
EVQLVESGGGLVQPGKSLRLSCAASGFTLDDYAMHWVRQAPGKGLEWVSGINWNSANIGYADSVKGRFTISRDNAKNSLYLQMNSLRTEDTALYYCAKVPGYSGGWIDAFDVWGQGTMVTVSS

SEQ ID NO: 68 - protein, 108 aa, Artificial Sequence; identical to SEQ ID NO: 12
  Synthetic: P1-061029 VL

SEQ ID NO: 69 - protein, 452 aa, Artificial Sequence
  Synthetic: P1-061029 IgG1.3 HC
EVQLVESGGGLVQPGKSLRLSCAASGFTLDDYAMHWVRQAPGKGLEWVSGINWNSANIGYADSVKGRFTISRDNAKNSLYLQMNSLRTEDTALYYCAKVPGYSGGWIDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 70 - protein, 215 aa, Artificial Sequence; identical to SEQ ID NO: 14
  Synthetic: P1-061029 LC

SEQ ID NO: 71 - protein, 123 aa, Artificial Sequence
  Synthetic: P1-068757 VH
EVQLVESGGGLVQPGKSLRLSCAASGFTLEDEAMHWVRQAPGKGLEWVSGINWNSEEIGYADSVKGRFTISRDNAKNSLYLQMNSLRTEDTALYYCAKVPGYSGGWIDAEDDWGQGTMVTVSS

SEQ ID NO: 72 - protein, 108 aa, Artificial Sequence; identical to SEQ ID NO: 12
  Synthetic: P1-068757 VL

SEQ ID NO: 73 - protein, 452 aa, Artificial Sequence
  Synthetic: P1-068757 IgG1.3 HC
EVQLVESGGGLVQPGKSLRLSCAASGFTLEDEAMHWVRQAPGKGLEWVSGINWNSEEIGYADSVKGRFTISRDNAKNSLYLQMNSLRTEDTALYYCAKVPGYSGGWIDAEDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 74 - protein, 215 aa, Artificial Sequence; identical to SEQ ID NO: 14
  Synthetic: P1-068757 LC

SEQ ID NO: 75 - protein, 123 aa, Artificial Sequence
  Synthetic: P1-068771 VH
EVQLVESGGGLVQPGKSLRLSCAASGFTLEDEAMHWVRQAPGKGLEWVSGINWNSHEIGYADSVKGRFTISRDNAKNSLYLQMNSLRTEDTALYYCAKVPGYSGGWIDAEDDWGQGTMVTVSS

SEQ ID NO: 76 - protein, 108 aa, Artificial Sequence; identical to SEQ ID NO: 12
  Synthetic: P1-068771 VL

SEQ ID NO: 77 - protein, 452 aa, Artificial Sequence
  Synthetic: P1-068771 IgG1.3 HC
EVQLVESGGGLVQPGKSLRLSCAASGFTLEDEAMHWVRQAPGKGLEWVSGINWNSHEIGYADSVKGRFTISRDNAKNSLYLQMNSLRTEDTALYYCAKVPGYSGGWIDAEDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 78 - protein, 215 aa, Artificial Sequence; identical to SEQ ID NO: 14
  Synthetic: P1-068771 LC

SEQ ID NO: 79 - protein, 123 aa, Artificial Sequence
  Synthetic: P1-068775 VH
EVQLVESGGGLVQPGKSLRLSCAASGFTLEDEAMHWVRQAPGKGLEWVSGIDWNSEEIGYADSVKGRFTISRDNAKNSLYLQMNSLRTEDTALYYCAKVPGYSHGWIDAEDDWGQGTMVTVSS

SEQ ID NO: 80 - protein, 108 aa, Artificial Sequence; identical to SEQ ID NO: 12
  Synthetic: P1-068775 VL

SEQ ID NO: 81 - protein, 452 aa, Artificial Sequence
  Synthetic: P1-068775 IgG1.3 HC
EVQLVESGGGLVQPGKSLRLSCAASGFTLEDEAMHWVRQAPGKGLEWVSGIDWNSEEIGYADSVKGRFTISRDNAKNSLYLQMNSLRTEDTALYYCAKVPGYSHGWIDAEDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 82 - protein, 215 aa, Artificial Sequence; identical to SEQ ID NO: 14
  Synthetic: P1-068775 LC

SEQ ID NO: 83 - protein, 123 aa, Artificial Sequence
  Synthetic: P1-068769 VH
EVQLVESGGGLVQPGKSLRLSCAASGFTLEDEAMHWVRQAPGKGLEWVSGINWNSDHIGYADSVKGRFTISRDNAKNSLYLQMNSLRTEDTALYYCAKVPGYSGGWIDAEDDWGQGTMVTVSS

SEQ ID NO: 84 - protein, 108 aa, Artificial Sequence; identical to SEQ ID NO: 12
  Synthetic: P1-068769 VL

SEQ ID NO: 85 - protein, 452 aa, Artificial Sequence
  Synthetic: P1-068769 IgG1.3 HC
EVQLVESGGGLVQPGKSLRLSCAASGFTLEDEAMHWVRQAPGKGLEWVSGINWNSDHIGYADSVKGRFTISRDNAKNSLYLQMNSLRTEDTALYYCAKVPGYSGGWIDAEDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 86 - protein, 215 aa, Artificial Sequence; identical to SEQ ID NO: 14
  Synthetic: P1-068769 LC

SEQ ID NO: 87 - protein, 123 aa, Artificial Sequence
  Synthetic: P1-068759 VH
EVQLVESGGGLVQPGKSLRLSCAASGFTLEDEAMHWVRQAPGKGLEWVSGIDWNSENIGYADSVKGRFTISRDNAKNSLYLQMNSLRTEDTALYYCAKVPGYSGGWIDAEDDWGQGTMVTVSS

SEQ ID NO: 88 - protein, 108 aa, Artificial Sequence; identical to SEQ ID NO: 12
  Synthetic: P1-068759 VL

SEQ ID NO: 89 - protein, 452 aa, Artificial Sequence
  Synthetic: P1-068759 IgG1.3 HC
EVQLVESGGGLVQPGKSLRLSCAASGFTLEDEAMHWVRQAPGKGLEWVSGIDWNSENIGYADSVKGRFTISRDNAKNSLYLQMNSLRTEDTALYYCAKVPGYSGGWIDAEDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 90 - protein, 215 aa, Artificial Sequence; identical to SEQ ID NO: 14
  Synthetic: P1-068759 LC

SEQ ID NO: 91 - protein, 123 aa, Artificial Sequence
  Synthetic: P1-068763 VH
EVQLVESGGGLVQPGKSLRLSCAASGFTLEDYAMHWVRQAPGKGLEWVSGIDWNSENIGYADSVKGRFTISRDNAKNSLYLQMNSLRTEDTALYYCAKVPGYSHGWIDAEDVWGQGTMVTVSS

SEQ ID NO: 92 - protein, 108 aa, Artificial Sequence; identical to SEQ ID NO: 12
  Synthetic: P1-068763 VL

SEQ ID NO: 93 - protein, 452 aa, Artificial Sequence
  Synthetic: P1-068763 IgG1.3 HC
EVQLVESGGGLVQPGKSLRLSCAASGFTLEDYAMHWVRQAPGKGLEWVSGIDWNSENIGYADSVKGRFTISRDNAKNSLYLQMNSLRTEDTALYYCAKVPGYSHGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 94 - protein, 215 aa, Artificial Sequence; identical to SEQ ID NO: 14
  Synthetic: P1-068763 LC

SEQ ID NO: 95 - protein, 121 aa, Artificial Sequence
  Synthetic: P1-061015 VH
QVQLVESGGGVVQPGRSLRLSCAASGFTFSSYAMHWVRQAPGKGLEWVAIIWYDGSNKYYADSVKGRFTISRDNSKNTLYLQMNSLRAEDTAVYYCARDSGFYSSYYFDYWGQGTLVTVSS

SEQ ID NO: 96 - protein, 108 aa, Artificial Sequence
  Synthetic: P1-061015 VL
EIVLTQSPATLSLSPGERATLSCRASQSVSSSYLAWYQQKPGQAPRLLIYDASNRATGIPARFSGSGSGTDFTLTISSLEPEDFATYYCQQYNSYPYTFGQGTKLEIK

SEQ ID NO: 97 - protein, 450 aa, Artificial Sequence
  Synthetic: P1-061015 IgG1.3 HC
QVQLVESGGGVVQPGRSLRLSCAASGFTFSSYAMHWVRQAPGKGLEWVAIIWYDGSNKYYADSVKGRFTISRDNSKNTLYLQMNSLRAEDTAVYYCARDSGFYSSYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 98 - protein, 215 aa, Artificial Sequence
  Synthetic: P1-061015 LC
EIVLTQSPATLSLSPGERATLSCRASQSVSSSYLAWYQQKPGQAPRLLIYDASNRATGIPARFSGSGSGTDFTLTISSLEPEDFATYYCQQYNSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 99 - protein, 121 aa, Artificial Sequence
  Synthetic: P1-068748 VH
QVQLVESGGGVVQPGRSLRLSCAASGFTFSHHAMHWVRQAPGKGLEWVAIIWYDGSNDDYADSVKGRFTISRDNSKNTLYLQMNSLRAEDTAVYYCARDSGFYDSYYFDYWGQGTLVTVSS

SEQ ID NO: 100 - protein, 108 aa, Artificial Sequence; identical to SEQ ID NO: 96
  Synthetic: P1-068748 VL

SEQ ID NO: 101 - protein, 450 aa, Artificial Sequence
  Synthetic: P1-068748 IgG1.3 HC
QVQLVESGGGVVQPGRSLRLSCAASGFTFSHHAMHWVRQAPGKGLEWVAIIWYDGSNDDYADSVKGRFTISRDNSKNTLYLQMNSLRAEDTAVYYCARDSGFYDSYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 102 - protein, 215 aa, Artificial Sequence; identical to SEQ ID NO: 98
  Synthetic: P1-068748 LC

SEQ ID NO: 103 - protein, 121 aa, Artificial Sequence
  Synthetic: P1-068744 VH
QVQLVESGGGVVQPGRSLRLSCAASGFTFSEYAMHWVRQAPGKGLEWVAHIWYDGSNKYEADSVKGRFTISRDNSKNTLYLQMNSLRAEDTAVYYCARDSGFYESYYFDEWGQGTLVTVSS

SEQ ID NO: 104 - protein, 108 aa, Artificial Sequence; identical to SEQ ID NO: 96
  Synthetic: P1-068744 VL

SEQ ID NO: 105 - protein, 450 aa, Artificial Sequence
  Synthetic: P1-068744 IgG1.3 HC
QVQLVESGGGVVQPGRSLRLSCAASGFTFSEYAMHWVRQAPGKGLEWVAHIWYDGSNKYEADSVKGRFTISRDNSKNTLYLQMNSLRAEDTAVYYCARDSGFYESYYFDEWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 106 - protein, 215 aa, Artificial Sequence; identical to SEQ ID NO: 98
  Synthetic: P1-068744 LC

SEQ ID NO: 107 - protein, 121 aa, Artificial Sequence
  Synthetic: P1-068736 VH
QVQLVESGGGVVQPGRSLRLSCAASGFTFSEYAMHWVRQAPGKGLEWVAIDWYDGSNKDYADSVKGRFTISRDNSKNTLYLQMNSLRAEDTAVYYCARDSGFYDSYYFDDWGQGTLVTVSS

SEQ ID NO: 108 - protein, 108 aa, Artificial Sequence; identical to SEQ ID NO: 96
  Synthetic: P1-068736 VL

SEQ ID NO: 109 - protein, 450 aa, Artificial Sequence
  Synthetic: P1-068736 IgG1.3 HC
QVQLVESGGGVVQPGRSLRLSCAASGFTFSEYAMHWVRQAPGKGLEWVAIDWYDGSNKDYADSVKGRFTISRDNSKNTLYLQMNSLRAEDTAVYYCARDSGFYDSYYFDDWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 110 - protein, 215 aa, Artificial Sequence; identical to SEQ ID NO: 98
  Synthetic: P1-068736 LC

SEQ ID NO: 111 - protein, 121 aa, Artificial Sequence
  Synthetic: P1-068752 VH
QVQLVESGGGVVQPGRSLRLSCAASGFTFSSYAMHWVRQAPGKGLEWVAEIWYDGSNKDYADSVKGRFTISRDNSKNTLYLQMNSLRAEDTAVYYCARDSGFYDSYYFDEWGQGTLVTVSS

SEQ ID NO: 112 - protein, 108 aa, Artificial Sequence; identical to SEQ ID NO: 96
  Synthetic: P1-068752 VL

SEQ ID NO: 113 - protein, 450 aa, Artificial Sequence
  Synthetic: P1-068752 IgG1.3 HC
QVQLVESGGGVVQPGRSLRLSCAASGFTFSSYAMHWVRQAPGKGLEWVAEIWYDGSNKDYADSVKGRFTISRDNSKNTLYLQMNSLRAEDTAVYYCARDSGFYDSYYFDEWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 114 - protein, 215 aa, Artificial Sequence; identical to SEQ ID NO: 98
  Synthetic: P1-068752 LC

SEQ ID NO: 115 - protein, 121 aa, Artificial Sequence
  Synthetic: P1-068740 VH
QVQLVESGGGVVQPGRSLRLSCAASGFTFSDYAMHWVRQAPGKGLEWVAIIWYDGSDKDYADSVKGRFTISRDNSKNTLYLQMNSLRAEDTAVYYCARDSGFYDSYYFDDWGQGTLVTVSS

SEQ ID NO: 116 - protein, 108 aa, Artificial Sequence; identical to SEQ ID NO: 96
  Synthetic: P1-068740 VL

SEQ ID NO: 117 - protein, 450 aa, Artificial Sequence
  Synthetic: P1-068740 IgG1.3 HC
QVQLVESGGGVVQPGRSLRLSCAASGFTFSDYAMHWVRQAPGKGLEWVAIIWYDGSDKDYADSVKGRFTISRDNSKNTLYLQMNSLRAEDTAVYYCARDSGFYDSYYFDDWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 118 - protein, 215 aa, Artificial Sequence; identical to SEQ ID NO: 98
  Synthetic: P1-068740 LC

SEQ ID NO: 119 - protein, 121 aa, Artificial Sequence
  Synthetic: P1-068742 VH
QVQLVESGGGVVQPGRSLRLSCAASGFTFSDYAMHWVRQAPGKGLEWVAIIWYDGSDKDYADSVKGRFTISRDNSKNTLYLQMNSLRAEDTAVYYCARDSGFYEDYYFDYWGQGTLVTVSS

SEQ ID NO: 120 - protein, 108 aa, Artificial Sequence; identical to SEQ ID NO: 96
  Synthetic: P1-068742 VL

SEQ ID NO: 121 - protein, 450 aa, Artificial Sequence
  Synthetic: P1-068742 IgG1.3 HC
QVQLVESGGGVVQPGRSLRLSCAASGFTFSDYAMHWVRQAPGKGLEWVAIIWYDGSDKDYADSVKGRFTISRDNSKNTLYLQMNSLRAEDTAVYYCARDSGFYEDYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 122 - protein, 215 aa, Artificial Sequence; identical to SEQ ID NO: 98
  Synthetic: P1-068742 LC

SEQ ID NO: 123 - protein, 121 aa, Artificial Sequence
  Synthetic: P1-068746 VH
QVQLVESGGGVVQPGRSLRLSCAASGFTFSSYAMHWVRQAPGKGLEWVAIIWYDGSNHHYADSVKGRFTISRDNSKNTLYLQMNSLRAEDTAVYYCARDSGFYDSYYFDYWGQGTLVTVSS

SEQ ID NO: 124 - protein, 108 aa, Artificial Sequence; identical to SEQ ID NO: 96
  Synthetic: P1-068746 VL

SEQ ID NO: 125 - protein, 450 aa, Artificial Sequence
  Synthetic: P1-068746 IgG1.3 HC
QVQLVESGGGVVQPGRSLRLSCAASGFTFSSYAMHWVRQAPGKGLEWVAIIWYDGSNHHYADSVKGRFTISRDNSKNTLYLQMNSLRAEDTAVYYCARDSGFYDSYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 126 - protein, 215 aa, Artificial Sequence; identical to SEQ ID NO: 98
  Synthetic: P1-068746 LC

SEQ ID NO: 127 - protein, 121 aa, Artificial Sequence
  Synthetic: P1-068750 VH
QVQLVESGGGVVQPGRSLRLSCAASGFTFSDYDMHWVRQAPGKGLEWVAEIWDDGSNKYYADSVKGRFTISRDNSKNTLYLQMNSLRAEDTAVYYCARDEEFYSSYYFDYWGQGTLVTVSS

SEQ ID NO: 128 - protein, 108 aa, Artificial Sequence; identical to SEQ ID NO: 96
  Synthetic: P1-068750 VL

SEQ ID NO: 129 - protein, 450 aa, Artificial Sequence
  Synthetic: P1-068750 IgG1.3 HC
QVQLVESGGGVVQPGRSLRLSCAASGFTFSDYDMHWVRQAPGKGLEWVAEIWDDGSNKYYADSVKGRFTISRDNSKNTLYLQMNSLRAEDTAVYYCARDEEFYSSYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 130 - protein, 215 aa, Artificial Sequence; identical to SEQ ID NO: 98
  Synthetic: P1-068750 LC

SEQ ID NO: 131 - protein, 121 aa, Artificial Sequence
  Synthetic: P1-068738 VH
QVQLVESGGGVVQPGRSLRLSCAASGFTFSEYAHHWVRQAPGKGLEWVAIIWDDGSNHYYADSVKGRFTISRDNSKNTLYLQMNSLRAEDTAVYYCARDSGFYEDYYFDYWGQGTLVTVSS

SEQ ID NO: 132 - protein, 108 aa, Artificial Sequence; identical to SEQ ID NO: 96
  Synthetic: P1-068738 VL

SEQ ID NO: 133 - protein, 450 aa, Artificial Sequence
  Synthetic: P1-068738 IgG1.3 HC
QVQLVESGGGVVQPGRSLRLSCAASGFTFSEYAHHWVRQAPGKGLEWVAIIWDDGSNHYYADSVKGRFTISRDNSKNTLYLQMNSLRAEDTAVYYCARDSGFYEDYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 134 - protein, 215 aa, Artificial Sequence; identical to SEQ ID NO: 98
  Synthetic: P1-068738 LC

SEQ ID NO: 135 - protein, 121 aa, Artificial Sequence
  Synthetic: P1-068754 VH
QVQLVESGGGVVQPGRSLRLSCAASGFTFSDYDMHWVRQAPGKGLEWVAEIWDDGSNKYYADSVKGRFTISRDNSKNTLYLQMNSLRAEDTAVYYCARDSGFHSDYYFDYWGQGTLVTVSS

SEQ ID NO: 136 - protein, 108 aa, Artificial Sequence; identical to SEQ ID NO: 96
  Synthetic: P1-068754 VL

SEQ ID NO: 137 - protein, 450 aa, Artificial Sequence
  Synthetic: P1-068754 IgG1.3 HC
QVQLVESGGGVVQPGRSLRLSCAASGFTFSDYDMHWVRQAPGKGLEWVAEIWDDGSNKYYADSVKGRFTISRDNSKNTLYLQMNSLRAEDTAVYYCARDSGFHSDYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 138 - protein, 215 aa, Artificial Sequence; identical to SEQ ID NO: 98
  Synthetic: P1-068754 LC

SEQ ID NO: 139 - protein, 123 aa, Artificial Sequence; identical to SEQ ID NO: 51
  Synthetic: P1-069293 VH (P1-068761.IgG1f)

SEQ ID NO: 140 - protein, 108 aa, Artificial Sequence; identical to SEQ ID NO: 12
  Synthetic: P1-069293 VL (P1-068761.IgG1f)

SEQ ID NO: 141 - protein, 452 aa, Artificial Sequence
  Synthetic: P1-069293 HC (P1-068761.IgG1f)
EVQLVESGGGLVQPGKSLRLSCAASGFTLEDEAMHWVRQAPGKGLEWVSGINWNSEEIGYADSVKGRFTISRDNAKNSLYLQMNSLRTEDTALYYCAKVPGYSHGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 142 - protein, 215 aa, Artificial Sequence; identical to SEQ ID NO: 14
  Synthetic: P1-069293 LC (P1-068761.IgG1f)

SEQ ID NO: 143 - protein, 123 aa, Artificial Sequence; identical to SEQ ID NO: 55
  Synthetic: P1-069298 VH (P1-068767.IgG1f)

SEQ ID NO: 144 - protein, 108 aa, Artificial Sequence; identical to SEQ ID NO: 12
  Synthetic: P1-069298 VL (P1-068767.IgG1f)

SEQ ID NO: 145 - protein, 452 aa, Artificial Sequence
  Synthetic: P1-069298 HC (P1-068767.IgG1f)
EVQLVESGGGLVQPGKSLRLSCAASGFTLEDYAMHWVRQAPGKGLEWVSGIDWNSENIGYADSVKGRFTISRDNAKNSLYLQMNSLRTEDTALYYCAKVPGYSGGWIDAEDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 146 - protein, 215 aa, Artificial Sequence; identical to SEQ ID NO: 14
  Synthetic: P1-069298 LC (P1-068767.IgG1f)

SEQ ID NO: 147 - protein, 123 aa, Artificial Sequence; identical to SEQ ID NO: 67
  Synthetic: P1-069302 VH (P1-061029.IgG1f)

SEQ ID NO: 148 - protein, 108 aa, Artificial Sequence; identical to SEQ ID NO: 12
  Synthetic: P1-069302 VL (P1-061029.IgG1f)

SEQ ID NO: 149 - protein, 452 aa, Artificial Sequence
  Synthetic: P1-069302 HC (P1-061029.IgG1f)
EVQLVESGGGLVQPGKSLRLSCAASGFTLDDYAMHWVRQAPGKGLEWVSGINWNSANIGYADSVKGRFTISRDNAKNSLYLQMNSLRTEDTALYYCAKVPGYSGGWIDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 150 - protein, 215 aa, Artificial Sequence; identical to SEQ ID NO: 14
  Synthetic: P1-069302 LC (P1-061029.IgG1f)

SEQ ID NO: 151 - protein, 123 aa, Artificial Sequence; identical to SEQ ID NO: 51
  Synthetic: P1-069312 VH (P1-068761.IgG1f afucosylated)

SEQ ID NO: 152 - protein, 108 aa, Artificial Sequence; identical to SEQ ID NO: 12
  Synthetic: P1-069312 VL (P1-068761.IgG1f afucosylated)

SEQ ID NO: 153 - protein, 452 aa, Artificial Sequence; identical to SEQ ID NO: 141
  Synthetic: P1-069312 HC (P1-068761.IgG1f afucosylated)

SEQ ID NO: 154 - protein, 215 aa, Artificial Sequence; identical to SEQ ID NO: 14
  Synthetic: P1-069312 LC (P1-068761.IgG1f afucosylated)

SEQ ID NO: 155 - protein, 123 aa, Artificial Sequence; identical to SEQ ID NO: 55
  Synthetic: P1-069309 VH (P1-068767.IgG1f afucosylated)

SEQ ID NO: 156 - protein, 108 aa, Artificial Sequence; identical to SEQ ID NO: 12
  Synthetic: P1-069309 VL (P1-068767.IgG1f afucosylated)

SEQ ID NO: 157 - protein, 452 aa, Artificial Sequence; identical to SEQ ID NO: 145
  Synthetic: P1-069309 HC (P1-068767.IgG1f afucosylated)

SEQ ID NO: 158 - protein, 215 aa, Artificial Sequence; identical to SEQ ID NO: 14
  Synthetic: P1-069309 LC (P1-068767.IgG1f afucosylated)

SEQ ID NO: 159 - protein, 123 aa, Artificial Sequence; identical to SEQ ID NO: 67
  Synthetic: P1-069307 VH (P1-061029.IgG1f afucosylated)

SEQ ID NO: 160 - protein, 108 aa, Artificial Sequence; identical to SEQ ID NO: 12
  Synthetic: P1-069307 VL (P1-061029.IgG1f afucosylated)

SEQ ID NO: 161 - protein, 452 aa, Artificial Sequence; identical to SEQ ID NO: 149
  Synthetic: P1-069307 HC (P1-061029.IgG1f afucosylated)

SEQ ID NO: 162 - protein, 215 aa, Artificial Sequence; identical to SEQ ID NO: 14
  Synthetic: P1-069307 LC (P1-061029.IgG1f afucosylated)

SEQ ID NO: 163 - protein, 329 aa, Artificial Sequence
  Synthetic: IgG1.3 (or IgG1.3f) heavy chain constant region (L234A, L235E, G237A)
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 164 - protein, 107 aa, Artificial Sequence [sequence omitted]

SEQ ID NO: 165 - protein, 311 aa, Homo sapiens; identical to SEQ ID NO: 1
  misc_feature (1)..(311): Human VISTA - V-type immunoglobulin domain-containing suppressor of T-cell activation precursor

SEQ ID NO: 166 - protein, 311 aa, Macaca fascicularis
  misc_feature (1)..(311): Cyno VISTA  - platelet receptor Gi24 isoform X2
MGVPTAPEAGCWRWGSLLFALFLAASLGPVAAFKVATLYSLYVCPEGQNVTLTCRVFGPVDKGHDVTFYKTWYRSSRGEVQTCSERRPIRNLTFQDLHLHHGGHQAANTSHDLAQRHGLESASDHHGNFSITMRNLTLLDSGLYCCLVVEIRHHHSEHRVHGAMELQVQTGKDAPSSCVAYPSSSQESENITAAALATGACIVGILCLPLILLLVYKQRQAASNRRAQELVRMDSNTQGIENPGFEASSPAQGILEAKVRHPLSYVAQRQPSESGRHLLSEPGTPLSPPGPGDVFFPSLDPVPDSPNFEVI

SEQ ID NO: 167 - protein, 309 aa, Mus musculus
  misc_feature (1)..(309): Mouse VISTA - V-type immunoglobulin domain-containing suppressor of T-cell activation isoform 1 precursor
MGVPAVPEASSPRWGTLLLAIFLAASRGLVAAFKVTTPYSLYVCPEGQNATLTCRILGPVSKGHDVTIYKTWYLSSRGEVQMCKEHRPIRNFTLQHLQHHGSHLKANASHDQPQKHGLELASDHHGNFSITLRNVTPRDSGLYCCLVIELKNHHPEQRFYGSMELQVQAGKGSGSTCMASNEQDSDSITAAALATGACIVGILCLPLILLLVYKQRQVASHRRAQELVRMDSSNTQGIENPGFETTPPFQGMPEAKTRPPLSYVAQRQPSESGRYLLSDPSTPLSPPGPGDVFFPSLDPVPDSPNSEAI

SEQ ID NO: 168 - protein, 14 aa, Artificial Sequence
  Synthetic: P1-061029 HDR3 chip oligo  (Fig. 7A)
  misc_feature (1)..(1): Xaa can be any naturally occurring amino acid
XPGYSGGWIDAFDV

SEQ ID NO: 169 - protein, 14 aa, Artificial Sequence
  Synthetic: P1-061029 HDR3 chip oligo  (Fig. 7A)
  misc_feature (1)..(2): Xaa can be any naturally occurring amino acid
XXGYSGGWIDAFDV

SEQ ID NO: 170 - protein, 14 aa, Artificial Sequence
  Synthetic: P1-061029 HDR3 chip oligo  (Fig. 7A)
  misc_feature (1)..(1): Xaa can be any naturally occurring amino acid
  misc_feature (3)..(3): Xaa can be any naturally occurring amino acid
XPXYSGGWIDAFDV

SEQ ID NO: 171 - protein, 14 aa, Artificial Sequence
  Synthetic: P1-061029 HDR3 chip oligo  (Fig. 7A)
  misc_feature (1)..(1): Xaa can be any naturally occurring amino acid
  misc_feature (4)..(4): Xaa can be any naturally occurring amino acid
XPGXSGGWIDAFDV

SEQ ID NO: 172 - protein, 14 aa, Artificial Sequence
  Synthetic: P1-061029 HDR3 chip oligo  (Fig. 7A)
  misc_feature (1)..(1): Xaa can be any naturally occurring amino acid
  misc_feature (5)..(5): Xaa can be any naturally occurring amino acid
XPGYXGGWIDAFDV

SEQ ID NO: 173 - protein, 14 aa, Artificial Sequence
  Synthetic: P1-061029 HDR3 chip oligo  (Fig. 7A)
  misc_feature (1)..(1): Xaa can be any naturally occurring amino acid
  misc_feature (6)..(6): Xaa can be any naturally occurring amino acid
XPGYSXGWIDAFDV

SEQ ID NO: 174 - protein, 14 aa, Artificial Sequence
  Synthetic: P1-061029 HDR3 chip oligo  (Fig. 7A)
  misc_feature (1)..(1): Xaa can be any naturally occurring amino acid
  misc_feature (7)..(7): Xaa can be any naturally occurring amino acid
XPGYSGXWIDAFDV

SEQ ID NO: 175 - protein, 14 aa, Artificial Sequence
  Synthetic: P1-061029 HDR3 chip oligo  (Fig. 7A)
  misc_feature (1)..(1): Xaa can be any naturally occurring amino acid
  misc_feature (8)..(8): Xaa can be any naturally occurring amino acid
XPGYSGGXIDAFDV

SEQ ID NO: 176 - protein, 14 aa, Artificial Sequence
  Synthetic: P1-061029 HDR3 chip oligo  (Fig. 7A)
  misc_feature (1)..(1): Xaa can be any naturally occurring amino acid
  misc_feature (9)..(9): Xaa can be any naturally occurring amino acid
XPGYSGGWXDAFDV

SEQ ID NO: 177 - protein, 14 aa, Artificial Sequence
  Synthetic: P1-061029 HDR3 chip oligo  (Fig. 7A)
  misc_feature (1)..(1): Xaa can be any naturally occurring amino acid
  misc_feature (10)..(10): Xaa can be any naturally occurring amino acid
XPGYSGGWIXAFDV

SEQ ID NO: 178 - protein, 14 aa, Artificial Sequence
  Synthetic: P1-061029 HDR3 chip oligo  (Fig. 7A)
  misc_feature (1)..(1): Xaa can be any naturally occurring amino acid
  misc_feature (11)..(11): Xaa can be any naturally occurring amino acid
XPGYSGGWIDXFDV

SEQ ID NO: 179 - protein, 14 aa, Artificial Sequence
  Synthetic: P1-061029 HDR3 chip oligo  (Fig. 7A)
  misc_feature (1)..(1): Xaa can be any naturally occurring amino acid
  misc_feature (12)..(12): Xaa can be any naturally occurring amino acid
XPGYSGGWIDAXDV

SEQ ID NO: 180 - protein, 14 aa, Artificial Sequence
  Synthetic: P1-061029 HDR3 chip oligo  (Fig. 7A)
  misc_feature (1)..(1): Xaa can be any naturally occurring amino acid
  misc_feature (13)..(13): Xaa can be any naturally occurring amino acid
XPGYSGGWIDAFXV

SEQ ID NO: 181 - protein, 14 aa, Artificial Sequence
  Synthetic: P1-061029 HDR3 chip oligo  (Fig. 7A)
  misc_feature (1)..(1): Xaa can be any naturally occurring amino acid
  misc_feature (14)..(14): Xaa can be any naturally occurring amino acid
XPGYSGGWIDAFDX

SEQ ID NO: 182 - protein, 329 aa, Homo sapiens
  misc_feature (1)..(329): IgG1f (human wild-type allotype f) heavy chain constant region
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 183 - protein, 329 aa, Artificial Sequence
  Synthetic: IgG1.1f  Heavy chain constant region (L234A, L235E, G237A, A330S, P331S)
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 184 - protein, 329 aa, Artificial Sequence
  Synthetic: IgG1fa.P238K (or IgG1.P238K) heavy chain constant region
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGKSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 185 - protein, 123 aa, Artificial Sequence
  Synthetic: P1-070864 P1-068761_E30D VH
EVQLVESGGGLVQPGKSLRLSCAASGFTLDDEAMHWVRQAPGKGLEWVSGINWNSEEIGYADSVKGRFTISRDNAKNSLYLQMNSLRTEDTALYYCAKVPGYSHGWIDAEDVWGQGTMVTVSS

SEQ ID NO: 186 - protein, 108 aa, Artificial Sequence; identical to SEQ ID NO: 12
  Synthetic: P1-070864 P1-068761_E30D VL

SEQ ID NO: 187 - protein, 452 aa, Artificial Sequence
  Synthetic: P1-070864 P1-068761_E30D IgG1.3 HC
EVQLVESGGGLVQPGKSLRLSCAASGFTLDDEAMHWVRQAPGKGLEWVSGINWNSEEIGYADSVKGRFTISRDNAKNSLYLQMNSLRTEDTALYYCAKVPGYSHGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 188 - protein, 215 aa, Artificial Sequence; identical to SEQ ID NO: 14
  Synthetic: P1-070864 P1-068761_E30D LC

SEQ ID NO: 189 - protein, 123 aa, Artificial Sequence
  Synthetic: P1-070866 P1-068761_E32Y VH
EVQLVESGGGLVQPGKSLRLSCAASGFTLEDYAMHWVRQAPGKGLEWVSGINWNSEEIGYADSVKGRFTISRDNAKNSLYLQMNSLRTEDTALYYCAKVPGYSHGWIDAEDVWGQGTMVTVSS

SEQ ID NO: 190 - protein, 108 aa, Artificial Sequence; identical to SEQ ID NO: 12
  Synthetic: P1-070866 P1-068761_E32Y VL

SEQ ID NO: 191 - protein, 452 aa, Artificial Sequence
  Synthetic: P1-070866 P1-068761_E32Y IgG1.3 HC
EVQLVESGGGLVQPGKSLRLSCAASGFTLEDYAMHWVRQAPGKGLEWVSGINWNSEEIGYADSVKGRFTISRDNAKNSLYLQMNSLRTEDTALYYCAKVPGYSHGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 192 - protein, 215 aa, Artificial Sequence; identical to SEQ ID NO: 14
  Synthetic: P1-070866 P1-068761_E32Y LC

SEQ ID NO: 193 - protein, 123 aa, Artificial Sequence
  Synthetic: P1-070868 P1-068761_E55A VH
EVQLVESGGGLVQPGKSLRLSCAASGFTLEDEAMHWVRQAPGKGLEWVSGINWNSAEIGYADSVKGRFTISRDNAKNSLYLQMNSLRTEDTALYYCAKVPGYSHGWIDAEDVWGQGTMVTVSS

SEQ ID NO: 194 - protein, 108 aa, Artificial Sequence; identical to SEQ ID NO: 12
  Synthetic: P1-070868 P1-068761_E55A VL

SEQ ID NO: 195 - protein, 452 aa, Artificial Sequence
  Synthetic: P1-070868 P1-068761_E55A IgG1.3 HC
EVQLVESGGGLVQPGKSLRLSCAASGFTLEDEAMHWVRQAPGKGLEWVSGINWNSAEIGYADSVKGRFTISRDNAKNSLYLQMNSLRTEDTALYYCAKVPGYSHGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 196 - protein, 215 aa, Artificial Sequence; identical to SEQ ID NO: 14
  Synthetic: P1-070868 P1-068761_E55A LC

SEQ ID NO: 197 - protein, 123 aa, Artificial Sequence
  Synthetic: P1-070870 P1-068761_E56N VH
EVQLVESGGGLVQPGKSLRLSCAASGFTLEDEAMHWVRQAPGKGLEWVSGINWNSENIGYADSVKGRFTISRDNAKNSLYLQMNSLRTEDTALYYCAKVPGYSHGWIDAEDVWGQGTMVTVSS

SEQ ID NO: 198 - protein, 108 aa, Artificial Sequence; identical to SEQ ID NO: 12
  Synthetic: P1-070870 P1-068761_E56N VL

SEQ ID NO: 199 - protein, 452 aa, Artificial Sequence
  Synthetic: P1-070870 P1-068761_E56N IgG1.3 HC
EVQLVESGGGLVQPGKSLRLSCAASGFTLEDEAMHWVRQAPGKGLEWVSGINWNSENIGYADSVKGRFTISRDNAKNSLYLQMNSLRTEDTALYYCAKVPGYSHGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 200 - protein, 215 aa, Artificial Sequence; identical to SEQ ID NO: 14
  Synthetic: P1-070870 P1-068761_E56N LC

SEQ ID NO: 201 - protein, 123 aa, Artificial Sequence
  Synthetic: P1-070872 P1-068761_H100G VH
EVQLVESGGGLVQPGKSLRLSCAASGFTLEDEAMHWVRQAPGKGLEWVSGINWNSEEIGYADSVKGRFTISRDNAKNSLYLQMNSLRTEDTALYYCAKVPGYSGGWIDAEDVWGQGTMVTVSS

SEQ ID NO: 202 - protein, 108 aa, Artificial Sequence; identical to SEQ ID NO: 12
  Synthetic: P1-070872 P1-068761_H100G VL

SEQ ID NO: 203 - protein, 452 aa, Artificial Sequence
  Synthetic: P1-070872 P1-068761_H100G IgG1.3 HC
EVQLVESGGGLVQPGKSLRLSCAASGFTLEDEAMHWVRQAPGKGLEWVSGINWNSEEIGYADSVKGRFTISRDNAKNSLYLQMNSLRTEDTALYYCAKVPGYSGGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 204 - protein, 215 aa, Artificial Sequence; identical to SEQ ID NO: 14
  Synthetic: P1-070872 P1-068761_H100G LC

SEQ ID NO: 205 - protein, 123 aa, Artificial Sequence
  Synthetic: P1-070874 P1-068761_E100fF VH
EVQLVESGGGLVQPGKSLRLSCAASGFTLEDEAMHWVRQAPGKGLEWVSGINWNSEEIGYADSVKGRFTISRDNAKNSLYLQMNSLRTEDTALYYCAKVPGYSHGWIDAFDVWGQGTMVTVSS

SEQ ID NO: 206 - protein, 108 aa, Artificial Sequence; identical to SEQ ID NO: 12
  Synthetic: P1-070874 P1-068761_E100fF VL

SEQ ID NO: 207 - protein, 452 aa, Artificial Sequence
  Synthetic: P1-070874 P1-068761_E100fF IgG1.3 HC
EVQLVESGGGLVQPGKSLRLSCAASGFTLEDEAMHWVRQAPGKGLEWVSGINWNSEEIGYADSVKGRFTISRDNAKNSLYLQMNSLRTEDTALYYCAKVPGYSHGWIDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 208 - protein, 215 aa, Artificial Sequence; identical to SEQ ID NO: 14
  Synthetic: P1-070874 P1-068761_E100fF LC

SEQ ID NO: 209 - protein, 123 aa, Artificial Sequence
  Synthetic: P1-070876 P1-068761_E30D_E32Y VH
EVQLVESGGGLVQPGKSLRLSCAASGFTLDDYAMHWVRQAPGKGLEWVSGINWNSEEIGYADSVKGRFTISRDNAKNSLYLQMNSLRTEDTALYYCAKVPGYSHGWIDAEDVWGQGTMVTVSS

SEQ ID NO: 210 - protein, 108 aa, Artificial Sequence; identical to SEQ ID NO: 12
  Synthetic: P1-070876 P1-068761_E30D_E32Y VL

SEQ ID NO: 211 - protein, 452 aa, Artificial Sequence
  Synthetic: P1-070876 P1-068761_E30D_E32Y IgG1.3 HC
EVQLVESGGGLVQPGKSLRLSCAASGFTLDDYAMHWVRQAPGKGLEWVSGINWNSEEIGYADSVKGRFTISRDNAKNSLYLQMNSLRTEDTALYYCAKVPGYSHGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 212 - protein, 215 aa, Artificial Sequence; identical to SEQ ID NO: 14
  Synthetic: P1-070876 P1-068761_E30D_E32Y LC

SEQ ID NO: 213 - protein, 123 aa, Artificial Sequence
  Synthetic: P1-070878 P1-068761_E55A_E56N VH
EVQLVESGGGLVQPGKSLRLSCAASGFTLEDEAMHWVRQAPGKGLEWVSGINWNSANIGYADSVKGRFTISRDNAKNSLYLQMNSLRTEDTALYYCAKVPGYSHGWIDAEDVWGQGTMVTVSS

SEQ ID NO: 214 - protein, 108 aa, Artificial Sequence; identical to SEQ ID NO: 12
  Synthetic: P1-070878 P1-068761_E55A_E56N VL

SEQ ID NO: 215 - protein, 452 aa, Artificial Sequence
  Synthetic: P1-070878 P1-068761_E55A_E56N IgG1.3 HC
EVQLVESGGGLVQPGKSLRLSCAASGFTLEDEAMHWVRQAPGKGLEWVSGINWNSANIGYADSVKGRFTISRDNAKNSLYLQMNSLRTEDTALYYCAKVPGYSHGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 216 - protein, 215 aa, Artificial Sequence; identical to SEQ ID NO: 14
  Synthetic: P1-070878 P1-068761_E55A_E56N LC

SEQ ID NO: 217 - protein, 123 aa, Artificial Sequence
  Synthetic: P1-070880 P1-068761_H100G_E100fF VH
EVQLVESGGGLVQPGKSLRLSCAASGFTLEDEAMHWVRQAPGKGLEWVSGINWNSEEIGYADSVKGRFTISRDNAKNSLYLQMNSLRTEDTALYYCAKVPGYSGGWIDAFDVWGQGTMVTVSS

SEQ ID NO: 218 - protein, 108 aa, Artificial Sequence; identical to SEQ ID NO: 12
  Synthetic: P1-070880 P1-068761_H100G_E100fF VL

SEQ ID NO: 219 - protein, 452 aa, Artificial Sequence
  Synthetic: P1-070880 P1-068761_H100G_E100fF IgG1.3 HC
EVQLVESGGGLVQPGKSLRLSCAASGFTLEDEAMHWVRQAPGKGLEWVSGINWNSEEIGYADSVKGRFTISRDNAKNSLYLQMNSLRTEDTALYYCAKVPGYSGGWIDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 220 - protein, 215 aa, Artificial Sequence; identical to SEQ ID NO: 14
  Synthetic: P1-070880 P1-068761_H100G_E100fF LC

SEQ ID NO: 221 - protein, 123 aa, Artificial Sequence
  Synthetic: P1-070882 P1-068761_E32Y_E55A VH
EVQLVESGGGLVQPGKSLRLSCAASGFTLEDYAMHWVRQAPGKGLEWVSGINWNSAEIGYADSVKGRFTISRDNAKNSLYLQMNSLRTEDTALYYCAKVPGYSHGWIDAEDVWGQGTMVTVSS

SEQ ID NO: 222 - protein, 108 aa, Artificial Sequence; identical to SEQ ID NO: 12
  Synthetic: P1-070882 P1-068761_E32Y_E55A VL

SEQ ID NO: 223 - protein, 452 aa, Artificial Sequence
  Synthetic: P1-070882 P1-068761_E32Y_E55A IgG1.3 HC
EVQLVESGGGLVQPGKSLRLSCAASGFTLEDYAMHWVRQAPGKGLEWVSGINWNSAEIGYADSVKGRFTISRDNAKNSLYLQMNSLRTEDTALYYCAKVPGYSHGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 224 - protein, 215 aa, Artificial Sequence; identical to SEQ ID NO: 14
  Synthetic: P1-070882 P1-068761_E32Y_E55A LC

SEQ ID NO: 225 - protein, 123 aa, Artificial Sequence
  Synthetic: P1-070884 P1-068761_E32Y_E56N VH
EVQLVESGGGLVQPGKSLRLSCAASGFTLEDYAMHWVRQAPGKGLEWVSGINWNSENIGYADSVKGRFTISRDNAKNSLYLQMNSLRTEDTALYYCAKVPGYSHGWIDAEDVWGQGTMVTVSS

SEQ ID NO: 226 - protein, 108 aa, Artificial Sequence; identical to SEQ ID NO: 12
  Synthetic: P1-070884 P1-068761_E32Y_E56N VL

SEQ ID NO: 227 - protein, 452 aa, Artificial Sequence
  Synthetic: P1-070884 P1-068761_E32Y_E56N IgG1.3 HC
EVQLVESGGGLVQPGKSLRLSCAASGFTLEDYAMHWVRQAPGKGLEWVSGINWNSENIGYADSVKGRFTISRDNAKNSLYLQMNSLRTEDTALYYCAKVPGYSHGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 228 - protein, 215 aa, Artificial Sequence; identical to SEQ ID NO: 14
  Synthetic: P1-070884 P1-068761_E32Y_E56N LC

SEQ ID NO: 229 - protein, 123 aa, Artificial Sequence
  Synthetic: P1-070886 P1-068761_E32Y_H100G VH
EVQLVESGGGLVQPGKSLRLSCAASGFTLEDYAMHWVRQAPGKGLEWVSGINWNSEEIGYADSVKGRFTISRDNAKNSLYLQMNSLRTEDTALYYCAKVPGYSGGWIDAEDVWGQGTMVTVSS

SEQ ID NO: 230 - protein, 108 aa, Artificial Sequence; identical to SEQ ID NO: 12
  Synthetic: P1-070886 P1-068761_E32Y_H100G VL

SEQ ID NO: 231 - protein, 452 aa, Artificial Sequence
  Synthetic: P1-070886 P1-068761_E32Y_H100G IgG1.3 HC
EVQLVESGGGLVQPGKSLRLSCAASGFTLEDYAMHWVRQAPGKGLEWVSGINWNSEEIGYADSVKGRFTISRDNAKNSLYLQMNSLRTEDTALYYCAKVPGYSGGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 232 - protein, 215 aa, Artificial Sequence; identical to SEQ ID NO: 14
  Synthetic: P1-070886 P1-068761_E32Y_H100G LC

SEQ ID NO: 233 - protein, 123 aa, Artificial Sequence
  Synthetic: P1-070888 P1-068761_E32Y_E100fF VH
EVQLVESGGGLVQPGKSLRLSCAASGFTLEDYAMHWVRQAPGKGLEWVSGINWNSEEIGYADSVKGRFTISRDNAKNSLYLQMNSLRTEDTALYYCAKVPGYSHGWIDAFDVWGQGTMVTVSS

SEQ ID NO: 234 - protein, 108 aa, Artificial Sequence; identical to SEQ ID NO: 12
  Synthetic: P1-070888 P1-068761_E32Y_E100fF VL

SEQ ID NO: 235 - protein, 452 aa, Artificial Sequence
  Synthetic: P1-070888 P1-068761_E32Y_E100fF IgG1.3 HC
EVQLVESGGGLVQPGKSLRLSCAASGFTLEDYAMHWVRQAPGKGLEWVSGINWNSEEIGYADSVKGRFTISRDNAKNSLYLQMNSLRTEDTALYYCAKVPGYSHGWIDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 236 - protein, 215 aa, Artificial Sequence; identical to SEQ ID NO: 14
  Synthetic: P1-070888 P1-068761_E32Y_E100fF LC

SEQ ID NO: 237 - protein, 123 aa, Artificial Sequence
  Synthetic: P1-070890 P1-068761_E30D_E55A VH
EVQLVESGGGLVQPGKSLRLSCAASGFTLDDEAMHWVRQAPGKGLEWVSGINWNSAEIGYADSVKGRFTISRDNAKNSLYLQMNSLRTEDTALYYCAKVPGYSHGWIDAEDVWGQGTMVTVSS

SEQ ID NO: 238 - protein, 108 aa, Artificial Sequence; identical to SEQ ID NO: 12
  Synthetic: P1-070890 P1-068761_E30D_E55A VL

SEQ ID NO: 239 - protein, 452 aa, Artificial Sequence
  Synthetic: P1-070890 P1-068761_E30D_E55A IgG1.3 HC
EVQLVESGGGLVQPGKSLRLSCAASGFTLDDEAMHWVRQAPGKGLEWVSGINWNSAEIGYADSVKGRFTISRDNAKNSLYLQMNSLRTEDTALYYCAKVPGYSHGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 240 - protein, 215 aa, Artificial Sequence; identical to SEQ ID NO: 14
  Synthetic: P1-070890 P1-068761_E30D_E55A LC

SEQ ID NO: 241 - protein, 123 aa, Artificial Sequence
  Synthetic: P1-070892 P1-068761_E30D_E56N VH
EVQLVESGGGLVQPGKSLRLSCAASGFTLDDEAMHWVRQAPGKGLEWVSGINWNSENIGYADSVKGRFTISRDNAKNSLYLQMNSLRTEDTALYYCAKVPGYSHGWIDAEDVWGQGTMVTVSS

SEQ ID NO: 242 - protein, 108 aa, Artificial Sequence; identical to SEQ ID NO: 12
  Synthetic: P1-070892 P1-068761_E30D_E56N VL

SEQ ID NO: 243 - protein, 452 aa, Artificial Sequence
  Synthetic: P1-070892 P1-068761_E30D_E56N IgG1.3 HC
EVQLVESGGGLVQPGKSLRLSCAASGFTLDDEAMHWVRQAPGKGLEWVSGINWNSENIGYADSVKGRFTISRDNAKNSLYLQMNSLRTEDTALYYCAKVPGYSHGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 244 - protein, 215 aa, Artificial Sequence; identical to SEQ ID NO: 14
  Synthetic: P1-070892 P1-068761_E30D_E56N LC

SEQ ID NO: 245 - protein, 123 aa, Artificial Sequence
  Synthetic: P1-070894 P1-068761_E30D_H100G VH
EVQLVESGGGLVQPGKSLRLSCAASGFTLDDEAMHWVRQAPGKGLEWVSGINWNSEEIGYADSVKGRFTISRDNAKNSLYLQMNSLRTEDTALYYCAKVPGYSGGWIDAEDVWGQGTMVTVSS

SEQ ID NO: 246 - protein, 108 aa, Artificial Sequence; identical to SEQ ID NO: 12
  Synthetic: P1-070894 P1-068761_E30D_H100G VL

SEQ ID NO: 247 - protein, 452 aa, Artificial Sequence
  Synthetic: P1-070894 P1-068761_E30D_H100G IgG1.3 HC
EVQLVESGGGLVQPGKSLRLSCAASGFTLDDEAMHWVRQAPGKGLEWVSGINWNSEEIGYADSVKGRFTISRDNAKNSLYLQMNSLRTEDTALYYCAKVPGYSGGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 248 - protein, 215 aa, Artificial Sequence; identical to SEQ ID NO: 14
  Synthetic: P1-070894 P1-068761_E30D_H100G LC

SEQ ID NO: 249 - protein, 123 aa, Artificial Sequence
  Synthetic: P1-070896 P1-068761_E30D_E100fF VH
EVQLVESGGGLVQPGKSLRLSCAASGFTLDDEAMHWVRQAPGKGLEWVSGINWNSEEIGYADSVKGRFTISRDNAKNSLYLQMNSLRTEDTALYYCAKVPGYSHGWIDAFDVWGQGTMVTVSS

SEQ ID NO: 250 - protein, 108 aa, Artificial Sequence; identical to SEQ ID NO: 12
  Synthetic: P1-070896 P1-068761_E30D_E100fF VL

SEQ ID NO: 251 - protein, 452 aa, Artificial Sequence
  Synthetic: P1-070896 P1-068761_E30D_E100fF IgG1.3 HC
EVQLVESGGGLVQPGKSLRLSCAASGFTLDDEAMHWVRQAPGKGLEWVSGINWNSEEIGYADSVKGRFTISRDNAKNSLYLQMNSLRTEDTALYYCAKVPGYSHGWIDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 252 - protein, 215 aa, Artificial Sequence; identical to SEQ ID NO: 14
  Synthetic: P1-070896 P1-068761_E30D_E100fF LC

SEQ ID NO: 253 - protein, 123 aa, Artificial Sequence
  Synthetic: P1-070898 P1-068761_E55A_E100fF VH
EVQLVESGGGLVQPGKSLRLSCAASGFTLEDEAMHWVRQAPGKGLEWVSGINWNSAEIGYADSVKGRFTISRDNAKNSLYLQMNSLRTEDTALYYCAKVPGYSHGWIDAFDVWGQGTMVTVSS

SEQ ID NO: 254 - protein, 108 aa, Artificial Sequence; identical to SEQ ID NO: 12
  Synthetic: P1-070898 P1-068761_E55A_E100fF VL

SEQ ID NO: 255 - protein, 452 aa, Artificial Sequence
  Synthetic: P1-070898 P1-068761_E55A_E100fF IgG1.3 HC
EVQLVESGGGLVQPGKSLRLSCAASGFTLEDEAMHWVRQAPGKGLEWVSGINWNSAEIGYADSVKGRFTISRDNAKNSLYLQMNSLRTEDTALYYCAKVPGYSHGWIDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 256 - protein, 215 aa, Artificial Sequence; identical to SEQ ID NO: 14
  Synthetic: P1-070898 P1-068761_E55A_E100fF LC

SEQ ID NO: 257 - protein, 123 aa, Artificial Sequence
  Synthetic: P1-070900 P1-068761_E56N_H100G VH
EVQLVESGGGLVQPGKSLRLSCAASGFTLEDEAMHWVRQAPGKGLEWVSGINWNSENIGYADSVKGRFTISRDNAKNSLYLQMNSLRTEDTALYYCAKVPGYSGGWIDAEDVWGQGTMVTVSS

SEQ ID NO: 258 - protein, 108 aa, Artificial Sequence; identical to SEQ ID NO: 12
  Synthetic: P1-070900 P1-068761_E56N_H100G VL

SEQ ID NO: 259 - protein, 452 aa, Artificial Sequence
  Synthetic: P1-070900 P1-068761_E56N_H100G IgG1.3 HC
EVQLVESGGGLVQPGKSLRLSCAASGFTLEDEAMHWVRQAPGKGLEWVSGINWNSENIGYADSVKGRFTISRDNAKNSLYLQMNSLRTEDTALYYCAKVPGYSGGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 260 - protein, 215 aa, Artificial Sequence; identical to SEQ ID NO: 14
  Synthetic: P1-070900 P1-068761_E56N_H100G LC

SEQ ID NO: 261 - protein, 123 aa, Artificial Sequence
  Synthetic: P1-070902 P1-068761_E56N_E100fF VH
EVQLVESGGGLVQPGKSLRLSCAASGFTLEDEAMHWVRQAPGKGLEWVSGINWNSENIGYADSVKGRFTISRDNAKNSLYLQMNSLRTEDTALYYCAKVPGYSHGWIDAFDVWGQGTMVTVSS

SEQ ID NO: 262 - protein, 108 aa, Artificial Sequence; identical to SEQ ID NO: 12
  Synthetic: P1-070902 P1-068761_E56N_E100fF VL

SEQ ID NO: 263 - protein, 452 aa, Artificial Sequence
  Synthetic: P1-070902 P1-068761_E56N_E100fF IgG1.3 HC
EVQLVESGGGLVQPGKSLRLSCAASGFTLEDEAMHWVRQAPGKGLEWVSGINWNSENIGYADSVKGRFTISRDNAKNSLYLQMNSLRTEDTALYYCAKVPGYSHGWIDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 264 - protein, 215 aa, Artificial Sequence; identical to SEQ ID NO: 14
  Synthetic: P1-070902 P1-068761_E56N_E100fF LC

SEQ ID NO: 265 - protein, 123 aa, Artificial Sequence
  Synthetic: P1-070904 P1-068767_E30D VH
EVQLVESGGGLVQPGKSLRLSCAASGFTLDDYAMHWVRQAPGKGLEWVSGIDWNSENIGYADSVKGRFTISRDNAKNSLYLQMNSLRTEDTALYYCAKVPGYSGGWIDAEDDWGQGTMVTVSS

SEQ ID NO: 266 - protein, 108 aa, Artificial Sequence; identical to SEQ ID NO: 12
  Synthetic: P1-070904 P1-068767_E30D VL

SEQ ID NO: 267 - protein, 452 aa, Artificial Sequence
  Synthetic: P1-070904 P1-068767_E30D IgG1.3 HC
EVQLVESGGGLVQPGKSLRLSCAASGFTLDDYAMHWVRQAPGKGLEWVSGIDWNSENIGYADSVKGRFTISRDNAKNSLYLQMNSLRTEDTALYYCAKVPGYSGGWIDAEDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 268 - protein, 215 aa, Artificial Sequence; identical to SEQ ID NO: 14
  Synthetic: P1-070904 P1-068767_E30D LC

SEQ ID NO: 269 - protein, 123 aa, Artificial Sequence
  Synthetic: P1-070906 P1-068767_D52N VH
EVQLVESGGGLVQPGKSLRLSCAASGFTLEDYAMHWVRQAPGKGLEWVSGINWNSENIGYADSVKGRFTISRDNAKNSLYLQMNSLRTEDTALYYCAKVPGYSGGWIDAEDDWGQGTMVTVSS

SEQ ID NO: 270 - protein, 108 aa, Artificial Sequence; identical to SEQ ID NO: 12
  Synthetic: P1-070906 P1-068767_D52N VL

SEQ ID NO: 271 - protein, 452 aa, Artificial Sequence
  Synthetic: P1-070906 P1-068767_D52N IgG1.3 HC
EVQLVESGGGLVQPGKSLRLSCAASGFTLEDYAMHWVRQAPGKGLEWVSGINWNSENIGYADSVKGRFTISRDNAKNSLYLQMNSLRTEDTALYYCAKVPGYSGGWIDAEDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 272 - protein, 215 aa, Artificial Sequence; identical to SEQ ID NO: 14
  Synthetic: P1-070906 P1-068767_D52N LC

SEQ ID NO: 273 - protein, 123 aa, Artificial Sequence
  Synthetic: P1-070908 P1-068767_E55A VH
EVQLVESGGGLVQPGKSLRLSCAASGFTLEDYAMHWVRQAPGKGLEWVSGIDWNSANIGYADSVKGRFTISRDNAKNSLYLQMNSLRTEDTALYYCAKVPGYSGGWIDAEDDWGQGTMVTVSS

SEQ ID NO: 274 - protein, 108 aa, Artificial Sequence; identical to SEQ ID NO: 12
  Synthetic: P1-070908 P1-068767_E55A VL

SEQ ID NO: 275 - protein, 452 aa, Artificial Sequence
  Synthetic: P1-070908 P1-068767_E55A IgG1.3 HC
EVQLVESGGGLVQPGKSLRLSCAASGFTLEDYAMHWVRQAPGKGLEWVSGIDWNSANIGYADSVKGRFTISRDNAKNSLYLQMNSLRTEDTALYYCAKVPGYSGGWIDAEDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 276 - protein, 215 aa, Artificial Sequence; identical to SEQ ID NO: 14
  Synthetic: P1-070908 P1-068767_E55A LC

SEQ ID NO: 277 - protein, 123 aa, Artificial Sequence
  Synthetic: P1-070910 P1-068767_E100fF VH
EVQLVESGGGLVQPGKSLRLSCAASGFTLEDYAMHWVRQAPGKGLEWVSGIDWNSENIGYADSVKGRFTISRDNAKNSLYLQMNSLRTEDTALYYCAKVPGYSGGWIDAFDDWGQGTMVTVSS

SEQ ID NO: 278 - protein, 108 aa, Artificial Sequence; identical to SEQ ID NO: 12
  Synthetic: P1-070910 P1-068767_E100fF VL

SEQ ID NO: 279 - protein, 452 aa, Artificial Sequence
  Synthetic: P1-070910 P1-068767_E100fF IgG1.3 HC
EVQLVESGGGLVQPGKSLRLSCAASGFTLEDYAMHWVRQAPGKGLEWVSGIDWNSENIGYADSVKGRFTISRDNAKNSLYLQMNSLRTEDTALYYCAKVPGYSGGWIDAFDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 280 - protein, 215 aa, Artificial Sequence; identical to SEQ ID NO: 14
  Synthetic: P1-070910 P1-068767_E100fF LC

SEQ ID NO: 281 - protein, 123 aa, Artificial Sequence
  Synthetic: P1-070912 P1-068767_D102V VH
EVQLVESGGGLVQPGKSLRLSCAASGFTLEDYAMHWVRQAPGKGLEWVSGIDWNSENIGYADSVKGRFTISRDNAKNSLYLQMNSLRTEDTALYYCAKVPGYSGGWIDAEDVWGQGTMVTVSS

SEQ ID NO: 282 - protein, 108 aa, Artificial Sequence; identical to SEQ ID NO: 12
  Synthetic: P1-070912 P1-068767_D102V VL

SEQ ID NO: 283 - protein, 452 aa, Artificial Sequence
  Synthetic: P1-070912 P1-068767_D102V IgG1.3 HC
EVQLVESGGGLVQPGKSLRLSCAASGFTLEDYAMHWVRQAPGKGLEWVSGIDWNSENIGYADSVKGRFTISRDNAKNSLYLQMNSLRTEDTALYYCAKVPGYSGGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 284 - protein, 215 aa, Artificial Sequence; identical to SEQ ID NO: 14
  Synthetic: P1-070912 P1-068767_D102V LC

SEQ ID NO: 285 - protein, 123 aa, Artificial Sequence
  Synthetic: P1-070914 P1-068767_E30D_D52N VH
EVQLVESGGGLVQPGKSLRLSCAASGFTLDDYAMHWVRQAPGKGLEWVSGINWNSENIGYADSVKGRFTISRDNAKNSLYLQMNSLRTEDTALYYCAKVPGYSGGWIDAEDDWGQGTMVTVSS

SEQ ID NO: 286 - protein, 108 aa, Artificial Sequence; identical to SEQ ID NO: 12
  Synthetic: P1-070914 P1-068767_E30D_D52N VL

SEQ ID NO: 287 - protein, 452 aa, Artificial Sequence
  Synthetic: P1-070914 P1-068767_E30D_D52N IgG1.3 HC
EVQLVESGGGLVQPGKSLRLSCAASGFTLDDYAMHWVRQAPGKGLEWVSGINWNSENIGYADSVKGRFTISRDNAKNSLYLQMNSLRTEDTALYYCAKVPGYSGGWIDAEDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 288 - protein, 215 aa, Artificial Sequence; identical to SEQ ID NO: 14
  Synthetic: P1-070914 P1-068767_E30D_D52N LC

SEQ ID NO: 289 - protein, 123 aa, Artificial Sequence
  Synthetic: P1-070916 P1-068767_D52N_E55A VH
EVQLVESGGGLVQPGKSLRLSCAASGFTLEDYAMHWVRQAPGKGLEWVSGINWNSANIGYADSVKGRFTISRDNAKNSLYLQMNSLRTEDTALYYCAKVPGYSGGWIDAEDDWGQGTMVTVSS

SEQ ID NO: 290 - protein, 108 aa, Artificial Sequence; identical to SEQ ID NO: 12
  Synthetic: P1-070916 P1-068767_D52N_E55A VL

SEQ ID NO: 291 - protein, 452 aa, Artificial Sequence
  Synthetic: P1-070916 P1-068767_D52N_E55A IgG1.3 HC
EVQLVESGGGLVQPGKSLRLSCAASGFTLEDYAMHWVRQAPGKGLEWVSGINWNSANIGYADSVKGRFTISRDNAKNSLYLQMNSLRTEDTALYYCAKVPGYSGGWIDAEDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 292 - protein, 215 aa, Artificial Sequence; identical to SEQ ID NO: 14
  Synthetic: P1-070916 P1-068767_D52N_E55A LC

SEQ ID NO: 293 - protein, 123 aa, Artificial Sequence
  Synthetic: P1-070918 P1-068767_E55A_E100fF VH
EVQLVESGGGLVQPGKSLRLSCAASGFTLEDYAMHWVRQAPGKGLEWVSGIDWNSANIGYADSVKGRFTISRDNAKNSLYLQMNSLRTEDTALYYCAKVPGYSGGWIDAFDDWGQGTMVTVSS

SEQ ID NO: 294 - protein, 108 aa, Artificial Sequence; identical to SEQ ID NO: 12
  Synthetic: P1-070918 P1-068767_E55A_E100fF VL

SEQ ID NO: 295 - protein, 452 aa, Artificial Sequence
  Synthetic: P1-070918 P1-068767_E55A_E100fF IgG1.3 HC
EVQLVESGGGLVQPGKSLRLSCAASGFTLEDYAMHWVRQAPGKGLEWVSGIDWNSANIGYADSVKGRFTISRDNAKNSLYLQMNSLRTEDTALYYCAKVPGYSGGWIDAFDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 296 - protein, 215 aa, Artificial Sequence; identical to SEQ ID NO: 14
  Synthetic: P1-070918 P1-068767_E55A_E100fF LC

SEQ ID NO: 297 - protein, 123 aa, Artificial Sequence
  Synthetic: P1-070920 P1-068767_E100fF_D102V VH
EVQLVESGGGLVQPGKSLRLSCAASGFTLEDYAMHWVRQAPGKGLEWVSGIDWNSENIGYADSVKGRFTISRDNAKNSLYLQMNSLRTEDTALYYCAKVPGYSGGWIDAFDVWGQGTMVTVSS

SEQ ID NO: 298 - protein, 108 aa, Artificial Sequence; identical to SEQ ID NO: 12
  Synthetic: P1-070920 P1-068767_E100fF_D102V VL

SEQ ID NO: 299 - protein, 452 aa, Artificial Sequence
  Synthetic: P1-070920 P1-068767_E100fF_D102V IgG1.3 HC
EVQLVESGGGLVQPGKSLRLSCAASGFTLEDYAMHWVRQAPGKGLEWVSGIDWNSENIGYADSVKGRFTISRDNAKNSLYLQMNSLRTEDTALYYCAKVPGYSGGWIDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 300 - protein, 215 aa, Artificial Sequence; identical to SEQ ID NO: 14
  Synthetic: P1-070920 P1-068767_E100fF_D102V LC

SEQ ID NO: 301 - protein, 123 aa, Artificial Sequence
  Synthetic: P1-070922 P1-068767_E30D_E55A VH
EVQLVESGGGLVQPGKSLRLSCAASGFTLDDYAMHWVRQAPGKGLEWVSGIDWNSANIGYADSVKGRFTISRDNAKNSLYLQMNSLRTEDTALYYCAKVPGYSGGWIDAEDDWGQGTMVTVSS

SEQ ID NO: 302 - protein, 108 aa, Artificial Sequence; identical to SEQ ID NO: 12
  Synthetic: P1-070922 P1-068767_E30D_E55A VL

SEQ ID NO: 303 - protein, 452 aa, Artificial Sequence
  Synthetic: P1-070922 P1-068767_E30D_E55A IgG1.3 HC
EVQLVESGGGLVQPGKSLRLSCAASGFTLDDYAMHWVRQAPGKGLEWVSGIDWNSANIGYADSVKGRFTISRDNAKNSLYLQMNSLRTEDTALYYCAKVPGYSGGWIDAEDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 304 - protein, 215 aa, Artificial Sequence; identical to SEQ ID NO: 14
  Synthetic: P1-070922 P1-068767_E30D_E55A LC

SEQ ID NO: 305 - protein, 123 aa, Artificial Sequence
  Synthetic: P1-070924 P1-068767_E30D_E100fF VH
EVQLVESGGGLVQPGKSLRLSCAASGFTLDDYAMHWVRQAPGKGLEWVSGIDWNSENIGYADSVKGRFTISRDNAKNSLYLQMNSLRTEDTALYYCAKVPGYSGGWIDAFDDWGQGTMVTVSS

SEQ ID NO: 306 - protein, 108 aa, Artificial Sequence; identical to SEQ ID NO: 12
  Synthetic: P1-070924 P1-068767_E30D_E100fF VL

SEQ ID NO: 307 - protein, 452 aa, Artificial Sequence
  Synthetic: P1-070924 P1-068767_E30D_E100fF IgG1.3 HC
EVQLVESGGGLVQPGKSLRLSCAASGFTLDDYAMHWVRQAPGKGLEWVSGIDWNSENIGYADSVKGRFTISRDNAKNSLYLQMNSLRTEDTALYYCAKVPGYSGGWIDAFDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 308 - protein, 215 aa, Artificial Sequence; identical to SEQ ID NO: 14
  Synthetic: P1-070924 P1-068767_E30D_E100fF LC

SEQ ID NO: 309 - protein, 123 aa, Artificial Sequence
  Synthetic: P1-070926 P1-068767_E30D_D102V VH
EVQLVESGGGLVQPGKSLRLSCAASGFTLDDYAMHWVRQAPGKGLEWVSGIDWNSENIGYADSVKGRFTISRDNAKNSLYLQMNSLRTEDTALYYCAKVPGYSGGWIDAEDVWGQGTMVTVSS

SEQ ID NO: 310 - protein, 108 aa, Artificial Sequence; identical to SEQ ID NO: 12
  Synthetic: P1-070926 P1-068767_E30D_D102V VL

SEQ ID NO: 311 - protein, 452 aa, Artificial Sequence
  Synthetic: P1-070926 P1-068767_E30D_D102V IgG1.3 HC
EVQLVESGGGLVQPGKSLRLSCAASGFTLDDYAMHWVRQAPGKGLEWVSGIDWNSENIGYADSVKGRFTISRDNAKNSLYLQMNSLRTEDTALYYCAKVPGYSGGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 312 - protein, 215 aa, Artificial Sequence; identical to SEQ ID NO: 14
  Synthetic: P1-070926 P1-068767_E30D_D102V LC

SEQ ID NO: 313 - protein, 123 aa, Artificial Sequence
  Synthetic: P1-070928 P1-068767_D52N_E100fF VH
EVQLVESGGGLVQPGKSLRLSCAASGFTLEDYAMHWVRQAPGKGLEWVSGINWNSENIGYADSVKGRFTISRDNAKNSLYLQMNSLRTEDTALYYCAKVPGYSGGWIDAFDDWGQGTMVTVSS

SEQ ID NO: 314 - protein, 108 aa, Artificial Sequence; identical to SEQ ID NO: 12
  Synthetic: P1-070928 P1-068767_D52N_E100fF VL

SEQ ID NO: 315 - protein, 452 aa, Artificial Sequence
  Synthetic: P1-070928 P1-068767_D52N_E100fF IgG1.3 HC
EVQLVESGGGLVQPGKSLRLSCAASGFTLEDYAMHWVRQAPGKGLEWVSGINWNSENIGYADSVKGRFTISRDNAKNSLYLQMNSLRTEDTALYYCAKVPGYSGGWIDAFDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 316 - protein, 215 aa, Artificial Sequence; identical to SEQ ID NO: 14
  Synthetic: P1-070928 P1-068767_D52N_E100fF LC

SEQ ID NO: 317 - protein, 123 aa, Artificial Sequence
  Synthetic: P1-070930 P1-068767_D52N_D102V VH
EVQLVESGGGLVQPGKSLRLSCAASGFTLEDYAMHWVRQAPGKGLEWVSGINWNSENIGYADSVKGRFTISRDNAKNSLYLQMNSLRTEDTALYYCAKVPGYSGGWIDAEDVWGQGTMVTVSS

SEQ ID NO: 318 - protein, 108 aa, Artificial Sequence; identical to SEQ ID NO: 12
  Synthetic: P1-070930 P1-068767_D52N_D102V VL

SEQ ID NO: 319 - protein, 452 aa, Artificial Sequence
  Synthetic: P1-070930 P1-068767_D52N_D102V IgG1.3 HC
EVQLVESGGGLVQPGKSLRLSCAASGFTLEDYAMHWVRQAPGKGLEWVSGINWNSENIGYADSVKGRFTISRDNAKNSLYLQMNSLRTEDTALYYCAKVPGYSGGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 320 - protein, 215 aa, Artificial Sequence; identical to SEQ ID NO: 14
  Synthetic: P1-070930 P1-068767_D52N_D102V LC

SEQ ID NO: 321 - protein, 123 aa, Artificial Sequence
  Synthetic: P1-070932 P1-068767_E55A_D102V VH
EVQLVESGGGLVQPGKSLRLSCAASGFTLEDYAMHWVRQAPGKGLEWVSGIDWNSANIGYADSVKGRFTISRDNAKNSLYLQMNSLRTEDTALYYCAKVPGYSGGWIDAEDVWGQGTMVTVSS

SEQ ID NO: 322 - protein, 108 aa, Artificial Sequence; identical to SEQ ID NO: 12
  Synthetic: P1-070932 P1-068767_E55A_D102V VL

SEQ ID NO: 323 - protein, 452 aa, Artificial Sequence
  Synthetic: P1-070932 P1-068767_E55A_D102V IgG1.3 HC
EVQLVESGGGLVQPGKSLRLSCAASGFTLEDYAMHWVRQAPGKGLEWVSGIDWNSANIGYADSVKGRFTISRDNAKNSLYLQMNSLRTEDTALYYCAKVPGYSGGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 324 - protein, 215 aa, Artificial Sequence; identical to SEQ ID NO: 14
  Synthetic: P1-070932 P1-068767_E55A_D102V LC

SEQ ID NO: 325 - protein, 169 aa, Homo sapiens
  misc_feature (1)..(169): hVISTA-ECD
AFKVATPYSLYVCPEGQNVTLTCRLLGPVDKGHDVTFYKTWYRSSRGEVQTCSERRPIRNLTFQDLHLHHGGHQAANTSHDLAQRHGLESASDHHGNFSITMRNLTLLDSGLYCCLVVEIRHHHSEHRVHGAMELQVQTGKDAPSNCVVYPSSSQESENITAHHHHHHH

SEQ ID NO: 326 - protein, 169 aa, Macaca fascicularis
  misc_feature (1)..(169): Cyno VISTA-ECD
AFKVATLYSLYVCPEGQNVTLTCRVFGPVDKGHDVTFYKTWYRSSRGEVQTCSERRPIRNLTFQDLHLHHGGHQAANTSHDLAQRHGLESASDHHGNFSITMRNLTLLDSGLYCCLVVEIRHHHSEHRVHGAMELQVQTGKDAPSSCVAYPSSSQESENITAHHHHHHH

SEQ ID NO: 327 - DNA, 369 bp, Artificial Sequence
  Synthetic: P1-069059 VH DNA
gaggtgcagctggtggagtctgggggaggcttggtacagcctggcaagtccctgagactctcctgtgcagcctctggattcacccttgaagattatgccatgcactgggtccggcaagctccagggaagggcctggagtgggtctcaggtattaattggaacagtgaccatataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaagatgactggggccaagggacaatggtcaccgtctcttca

SEQ ID NO: 328 - DNA, 324 bp, Artificial Sequence
  Synthetic: P1-069059 VL DNA
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccattcactttcggccctgggaccaaagtggatatcaaa

SEQ ID NO: 329 - DNA, 369 bp, Artificial Sequence
  Synthetic: P1-069061 VH DNA
gaggtgcagctggtggagtctgggggaggcttggtacagcctggcaagtccctgagactctcctgtgcagcctctggattcacccttgaagattatgccatgcactgggtccggcaagctccagggaagggcctggagtgggtctcaggtattaattggaacagtgctgaaataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaagatgactggggccaagggacaatggtcaccgtctcttca

SEQ ID NO: 330 - DNA, 324 bp, Artificial Sequence; identical to SEQ ID NO: 328
  Synthetic: P1-069061 VL DNA

SEQ ID NO: 331 - DNA, 369 bp, Artificial Sequence
  Synthetic: P1-069063 VH DNA
gaggtgcagctggtggagtctgggggaggcttggtacagcctggcaagtccctgagactctcctgtgcagcctctggattcacccttgaagattatgccatgcactgggtccggcaagctccagggaagggcctggagtgggtctcaggtattaattggaacagtgctgaaataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgacgatgaatggggccaagggacaatggtcaccgtctcttca

SEQ ID NO: 332 - DNA, 324 bp, Artificial Sequence; identical to SEQ ID NO: 328
  Synthetic: P1-069063 VL DNA

SEQ ID NO: 333 - DNA, 369 bp, Artificial Sequence
  Synthetic: P1-069065 VH DNA
gaggtgcagctggtggagtctgggggaggcttggtacagcctggcaagtccctgagactctcctgtgcagcctctggattcacccttgaagatgaagccatgcactgggtccggcaagctccagggaagggcctggagtgggtctcaggtattaattggaacagtgacgacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgcttttgatgtctggggccaagggacaatggtcaccgtctcttca

SEQ ID NO: 334 - DNA, 324 bp, Artificial Sequence; identical to SEQ ID NO: 328
  Synthetic: P1-069065 VL DNA

SEQ ID NO: 335 - DNA, 369 bp, Artificial Sequence
  Synthetic: P1-069067 VH DNA
gaggtgcagctggtggagtctgggggaggcttggtacagcctggcaagtccctgagactctcctgtgcagcctctggattcacccttgatgattatgccatgcactgggtccggcaagctccagggaagggcctggagtgggtctcaggtattaattggaacagtgaagaaataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgacgatgaatggggccaagggacaatggtcaccgtctcttca

SEQ ID NO: 336 - DNA, 324 bp, Artificial Sequence; identical to SEQ ID NO: 328
  Synthetic: P1-069067 VL DNA

SEQ ID NO: 337 - DNA, 369 bp, Artificial Sequence
  Synthetic: P1-069069 VH DNA
gaggtgcagctggtggagtctgggggaggcttggtacagcctggcaagtccctgagactctcctgtgcagcctctggattcacccttgatgattatgccatgcactgggtccggcaagctccagggaagggcctggagtgggtctcaggtattaattggaacagtgaagaaataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgacgatgtctggggccaagggacaatggtcaccgtctcttca

SEQ ID NO: 338 - DNA, 324 bp, Artificial Sequence; identical to SEQ ID NO: 328
  Synthetic: P1-069069 VL DNA

SEQ ID NO: 339 - DNA, 369 bp, Artificial Sequence
  Synthetic: P1-069071 VH DNA
gaggtgcagctggtggagtctgggggaggcttggtacagcctggcaagtccctgagactctcctgtgcagcctctggattcacccttgaagatgaagccatgcactgggtccggcaagctccagggaagggcctggagtgggtctcaggtattaattggaacagtgctgacataggctatgcggactctgtgaagggccgattcaccatctccagagacaacgccaagaactccctgtatctgcaaatgaacagtctgagaactgaggacacggccttgtattactgtgcaaaagttcctgggtatagcgaaggctggattgacgcttttgatgtctggggccaagggacaatggtcaccgtctcttca

SEQ ID NO: 340 - DNA, 324 bp, Artificial Sequence; identical to SEQ ID NO: 328
  Synthetic: P1-069071 VL DNA

SEQ ID NO: 341 - DNA, 369 bp, Artificial Sequence
  Synthetic: P1-069073 VH DNA
gaggtgcagctggtggagtctgggggaggcttggtacagcctggcaagtccctgagactctcctgtgcagcctctggattcacccttgaagatgaagccatgcactgggtccggcaagctccagggaagggcctggagtgggtctcaggtattaattggaacagtgctgaaataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaagatgtctggggccaagggacaatggtcaccgtctcttca

SEQ ID NO: 342 - DNA, 324 bp, Artificial Sequence; identical to SEQ ID NO: 328
  Synthetic: P1-069073 VL DNA

SEQ ID NO: 343 - DNA, 369 bp, Artificial Sequence
  Synthetic: P1-069075 VH DNA
gaggtgcagctggtggagtctgggggaggcttggtacagcctggcaagtccctgagactctcctgtgcagcctctggattcacccttgaagattatgccatgcactgggtccggcaagctccagggaagggcctggagtgggtctcaggtattaattgggacagtgctgaaataggctatgcggactctgtgaagggccgattcaccatctccagagacaacgccaagaactccctgtatctgcaaatgaacagtctgagaactgaggacacggccttgtattactgtgcaaaagttcctgggtatagccatggctggattgacgctgaagatgtctggggccaagggacaatggtcaccgtctcttca

SEQ ID NO: 344 - DNA, 324 bp, Artificial Sequence; identical to SEQ ID NO: 328
  Synthetic: P1-069075 VL DNA

SEQ ID NO: 345 - DNA, 369 bp, Artificial Sequence
  Synthetic: P1-069077 VH DNA
gaggtgcagctggtggagtctgggggaggcttggtacagcctggcaagtccctgagactctcctgtgcagcctctggattcacccttgaagatgaagccatgcactgggtccggcaagctccagggaagggcctggagtgggtctcaggtattaattggaacagtgacgaaataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgcttttgatgtctggggccaagggacaatggtcaccgtctcttca

SEQ ID NO: 346 - DNA, 324 bp, Artificial Sequence; identical to SEQ ID NO: 328
  Synthetic: P1-069077 VL DNA

SEQ ID NO: 347 - DNA, 369 bp, Artificial Sequence
  Synthetic: P1-068761 VH DNA
gaggtgcagctggtggagtctgggggaggcttggtacagcctggcaagtccctgagactctcctgtgcagcctctggattcacccttgaggatgaggccatgcactgggtccggcaagctccagggaagggcctggagtgggtctcaggtattaattggaacagtgaagagataggctatgcggactctgtgaagggccgattcaccatctccagagacaacgccaagaactccctgtatctgcaaatgaacagtctgagaactgaggacacggccttgtattactgtgcaaaagttcctgggtatagccatggctggattgacgctgaagatgtctggggccaagggacaatggtcaccgtctcttca

SEQ ID NO: 348 - DNA, 324 bp, Artificial Sequence; identical to SEQ ID NO: 328
  Synthetic: P1-068761 VL DNA

SEQ ID NO: 349 - DNA, 369 bp, Artificial Sequence
  Synthetic: P1-068767 VH DNA
gaggtgcagctggtggagtctgggggaggcttggtacagcctggcaagtccctgagactctcctgtgcagcctctggattcacccttgaggattatgccatgcactgggtccggcaagctccagggaagggcctggagtgggtctcaggtattgattggaacagtgaaaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaagatgactggggccaagggacaatggtcaccgtctcttca

SEQ ID NO: 350 - DNA, 324 bp, Artificial Sequence; identical to SEQ ID NO: 328
  Synthetic: P1-068767 VL DNA

SEQ ID NO: 351 - DNA, 369 bp, Artificial Sequence
  Synthetic: P1-068773 VH DNA
gaggtgcagctggtggagtctgggggaggcttggtacagcctggcaagtccctgagactctcctgtgcagcctctggattcacccttgaggattatgccatgcactgggtccggcaagctccagggaagggcctggagtgggtctcaggtattgattggaacagtgataacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaagatgactggggccaagggacaatggtcaccgtctcttca

SEQ ID NO: 352 - DNA, 324 bp, Artificial Sequence; identical to SEQ ID NO: 328
  Synthetic: P1-068773 VL DNA

SEQ ID NO: 353 - DNA, 369 bp, Artificial Sequence
  Synthetic: P1-068765 VH DNA
gaggtgcagctggtggagtctgggggaggcttggtacagcctggcaagtccctgagactctcctgtgcagcctctggattcaccgatgaggattatgccatgcactgggtccggcaagctccagggaagggcctggagtgggtctcaggtattaattggaacagtgaagagataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaagatgactggggccaagggacaatggtcaccgtctcttca

SEQ ID NO: 354 - DNA, 324 bp, Artificial Sequence; identical to SEQ ID NO: 328
  Synthetic: P1-068765 VL DNA

SEQ ID NO: 355 - DNA, 369 bp, Artificial Sequence
  Synthetic: P1-061029 VH DNA
gaggtgcagctggtggagtctgggggaggcttggtacagcctggcaagtccctgagactctcctgtgcagcctctggattcacccttgatgattatgccatgcactgggtccggcaagctccagggaagggcctggagtgggtctcaggtattaattggaacagtgctaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgcttttgatgtctggggccaagggacaatggtcaccgtctcttca

SEQ ID NO: 356 - DNA, 324 bp, Artificial Sequence; identical to SEQ ID NO: 328
  Synthetic: P1-061029 VL DNA

SEQ ID NO: 357 - DNA, 369 bp, Artificial Sequence
  Synthetic: P1-068757 VH DNA
gaggtgcagctggtggagtctgggggaggcttggtacagcctggcaagtccctgagactctcctgtgcagcctctggattcacccttgaggatgaggccatgcactgggtccggcaagctccagggaagggcctggagtgggtctcaggtattaattggaacagtgaagagataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaagatgactggggccaagggacaatggtcaccgtctcttca

SEQ ID NO: 358 - DNA, 324 bp, Artificial Sequence; identical to SEQ ID NO: 328
  Synthetic: P1-068757 VL DNA

SEQ ID NO: 359 - DNA, 369 bp, Artificial Sequence
  Synthetic: P1-068771 VH DNA
gaggtgcagctggtggagtctgggggaggcttggtacagcctggcaagtccctgagactctcctgtgcagcctctggattcacccttgaggatgaggccatgcactgggtccggcaagctccagggaagggcctggagtgggtctcaggtattaattggaacagtcatgagataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaagatgactggggccaagggacaatggtcaccgtctcttca

SEQ ID NO: 360 - DNA, 324 bp, Artificial Sequence; identical to SEQ ID NO: 328
  Synthetic: P1-068771 VL DNA

SEQ ID NO: 361 - DNA, 369 bp, Artificial Sequence
  Synthetic: P1-068775 VH DNA
gaggtgcagctggtggagtctgggggaggcttggtacagcctggcaagtccctgagactctcctgtgcagcctctggattcacccttgaggatgaggccatgcactgggtccggcaagctccagggaagggcctggagtgggtctcaggtattgattggaacagtgaagagataggctatgcggactctgtgaagggccgattcaccatctccagagacaacgccaagaactccctgtatctgcaaatgaacagtctgagaactgaggacacggccttgtattactgtgcaaaagttcctgggtatagccatggctggattgacgctgaagatgactggggccaagggacaatggtcaccgtctcttca

SEQ ID NO: 362 - DNA, 324 bp, Artificial Sequence; identical to SEQ ID NO: 328
  Synthetic: P1-068775 VL DNA

SEQ ID NO: 363 - DNA, 369 bp, Artificial Sequence
  Synthetic: P1-068769 VH DNA
gaggtgcagctggtggagtctgggggaggcttggtacagcctggcaagtccctgagactctcctgtgcagcctctggattcacccttgaggatgaggccatgcactgggtccggcaagctccagggaagggcctggagtgggtctcaggtattaattggaacagtgatcacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaagatgactggggccaagggacaatggtcaccgtctcttca

SEQ ID NO: 364 - DNA, 324 bp, Artificial Sequence; identical to SEQ ID NO: 328
  Synthetic: P1-068769 VL DNA

SEQ ID NO: 365 - DNA, 369 bp, Artificial Sequence
  Synthetic: P1-068759 VH DNA
gaggtgcagctggtggagtctgggggaggcttggtacagcctggcaagtccctgagactctcctgtgcagcctctggattcacccttgaggatgaggccatgcactgggtccggcaagctccagggaagggcctggagtgggtctcaggtattgattggaacagtgaaaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaagatgactggggccaagggacaatggtcaccgtctcttca

SEQ ID NO: 366 - DNA, 324 bp, Artificial Sequence; identical to SEQ ID NO: 328
  Synthetic: P1-068759 VL DNA

SEQ ID NO: 367 - DNA, 369 bp, Artificial Sequence
  Synthetic: P1-068763 VH DNA
gaggtgcagctggtggagtctgggggaggcttggtacagcctggcaagtccctgagactctcctgtgcagcctctggattcacccttgaggattatgccatgcactgggtccggcaagctccagggaagggcctggagtgggtctcaggtattgattggaacagtgaaaacataggctatgcggactctgtgaagggccgattcaccatctccagagacaacgccaagaactccctgtatctgcaaatgaacagtctgagaactgaggacacggccttgtattactgtgcaaaagttcctgggtatagccatggctggattgacgctgaagatgtctggggccaagggacaatggtcaccgtctcttca

SEQ ID NO: 368 - DNA, 324 bp, Artificial Sequence; identical to SEQ ID NO: 328
  Synthetic: P1-068763 VL DNA

SEQ ID NO: 369 - DNA, 363 bp, Artificial Sequence
  Synthetic: P1-061015 VH DNA
caggtgcagctggtggagtctgggggaggcgtggtccagcctgggaggtccctgagactctcctgtgcagcgtctggattcaccttcagtagctatgccatgcactgggtccgccaggctccaggcaaggggctggagtgggtggcaattatatggtatgatggaagtaataaatactatgcagactccgtgaagggccgattcaccatctccagagacaattccaagaacacgctgtatctgcaaatgaacagcctgagagccgaggacacggctgtgtattactgtgcgagagatagtggtttttactcctcgtactactttgactactggggccagggaaccctggtcaccgtctcctca

SEQ ID NO: 370 - DNA, 324 bp, Artificial Sequence
  Synthetic: P1-061015 VL DNA
gaaattgtgttgacacagtctccagccaccctgtctttgtctccaggggaaagagccaccctctcctgcagggccagtcagagtgttagcagcagctacttagcctggtaccaacagaaacctggccaggctcccaggctcctcatctatgatgcatccaacagggccactggcatcccagccaggttcagcggcagtggatctgggacagatttcactctcaccatcagcagcctggagcctgaagattttgcaacttattactgccaacagtataatagttacccgtacacttttggccaggggaccaagctggagatcaaa

SEQ ID NO: 371 - DNA, 363 bp, Artificial Sequence
  Synthetic: P1-068748 VH DNA
caggtgcagctggtggagtctgggggaggcgtggtccagcctgggaggtccctgagactctcctgtgcagcgtctggattcaccttcagtcaccatgccatgcactgggtccgccaggctccaggcaaggggctggagtgggtggcaattatatggtatgatggaagtaatgacgactatgcagactccgtgaagggccgattcaccatctccagagacaattccaagaacacgctgtatctgcaaatgaacagcctgagagccgaggacacggctgtgtattactgtgcgagagatagtggtttttacgactcgtactactttgactactggggccagggaaccctggtcaccgtctcctca

SEQ ID NO: 372 - DNA, 324 bp, Artificial Sequence; identical to SEQ ID NO: 370
  Synthetic: P1-068748 VL DNA

SEQ ID NO: 373 - DNA, 363 bp, Artificial Sequence
  Synthetic: P1-068744 VH DNA
caggtgcagctggtggagtctgggggaggcgtggtccagcctgggaggtccctgagactctcctgtgcagcgtctggattcaccttcagtgagtatgccatgcactgggtccgccaggctccaggcaaggggctggagtgggtggcacatatatggtatgatggaagtaataaatacgaggcagactccgtgaagggccgattcaccatctccagagacaattccaagaacacgctgtatctgcaaatgaacagcctgagagccgaggacacggctgtgtattactgtgcgagagatagtggtttttacgaatcgtactactttgacgagtggggccagggaaccctggtcaccgtctcctca

SEQ ID NO: 374 - DNA, 324 bp, Artificial Sequence; identical to SEQ ID NO: 370
  Synthetic: P1-068744 VL DNA

SEQ ID NO: 375 - DNA, 363 bp, Artificial Sequence
  Synthetic: P1-068736 VH DNA
caggtgcagctggtggagtctgggggaggcgtggtccagcctgggaggtccctgagactctcctgtgcagcgtctggattcaccttcagtgagtatgccatgcactgggtccgccaggctccaggcaaggggctggagtgggtggcaattgattggtatgatggaagtaataaagactatgcagactccgtgaagggccgattcaccatctccagagacaattccaagaacacgctgtatctgcaaatgaacagcctgagagccgaggacacggctgtgtattactgtgcgagagatagtggtttttacgactcgtactactttgacgactggggccagggaaccctggtcaccgtctcctca

SEQ ID NO: 376 - DNA, 324 bp, Artificial Sequence; identical to SEQ ID NO: 370
  Synthetic: P1-068736 VL DNA

SEQ ID NO: 377 - DNA, 363 bp, Artificial Sequence
  Synthetic: P1-068752 VH DNA
caggtgcagctggtggagtctgggggaggcgtggtccagcctgggaggtccctgagactctcctgtgcagcgtctggattcaccttcagtagctatgccatgcactgggtccgccaggctccaggcaaggggctggagtgggtggcagagatatggtatgatggaagtaataaagactatgcagactccgtgaagggccgattcaccatctccagagacaattccaagaacacgctgtatctgcaaatgaacagcctgagagccgaggacacggctgtgtattactgtgcgagagatagtggtttttacgactcgtactactttgacgagtggggccagggaaccctggtcaccgtctcctca

SEQ ID NO: 378 - DNA, 324 bp, Artificial Sequence; identical to SEQ ID NO: 370
  Synthetic: P1-068752 VL DNA

SEQ ID NO: 379 - DNA, 363 bp, Artificial Sequence
  Synthetic: P1-068740 VH DNA
caggtgcagctggtggagtctgggggaggcgtggtccagcctgggaggtccctgagactctcctgtgcagcgtctggattcaccttcagtgactatgccatgcactgggtccgccaggctccaggcaaggggctggagtgggtggcaattatatggtatgatggaagtgataaagactatgcagactccgtgaagggccgattcaccatctccagagacaattccaagaacacgctgtatctgcaaatgaacagcctgagagccgaggacacggctgtgtattactgtgcgagagatagtggtttttacgactcgtactactttgacgactggggccagggaaccctggtcaccgtctcctca

SEQ ID NO: 380 - DNA, 324 bp, Artificial Sequence; identical to SEQ ID NO: 370
  Synthetic: P1-068740 VL DNA

SEQ ID NO: 381 - DNA, 363 bp, Artificial Sequence
  Synthetic: P1-068742 VH DNA
caggtgcagctggtggagtctgggggaggcgtggtccagcctgggaggtccctgagactctcctgtgcagcgtctggattcaccttcagtgactatgccatgcactgggtccgccaggctccaggcaaggggctggagtgggtggcaattatatggtatgatggaagtgataaagactatgcagactccgtgaagggccgattcaccatctccagagacaattccaagaacacgctgtatctgcaaatgaacagcctgagagccgaggacacggctgtgtattactgtgcgagagatagtggtttttacgaagattactactttgactactggggccagggaaccctggtcaccgtctcctca

SEQ ID NO: 382 - DNA, 324 bp, Artificial Sequence; identical to SEQ ID NO: 370
  Synthetic: P1-068742 VL DNA

SEQ ID NO: 383 - DNA, 363 bp, Artificial Sequence
  Synthetic: P1-068746 VH DNA
caggtgcagctggtggagtctgggggaggcgtggtccagcctgggaggtccctgagactctcctgtgcagcgtctggattcaccttcagtagctatgccatgcactgggtccgccaggctccaggcaaggggctggagtgggtggcaattatatggtatgatggaagtaatcaccactatgcagactccgtgaagggccgattcaccatctccagagacaattccaagaacacgctgtatctgcaaatgaacagcctgagagccgaggacacggctgtgtattactgtgcgagagatagtggtttttacgactcgtactactttgactactggggccagggaaccctggtcaccgtctcctca

SEQ ID NO: 384 - DNA, 324 bp, Artificial Sequence; identical to SEQ ID NO: 370
  Synthetic: P1-068746 VL DNA

SEQ ID NO: 385 - DNA, 363 bp, Artificial Sequence
  Synthetic: P1-068750 VH DNA
caggtgcagctggtggagtctgggggaggcgtggtccagcctgggaggtccctgagactctcctgtgcagcgtctggattcaccttcagtgactatgacatgcactgggtccgccaggctccaggcaaggggctggagtgggtggcagagatatgggatgatggaagtaataaatactatgcagactccgtgaagggccgattcaccatctccagagacaattccaagaacacgctgtatctgcaaatgaacagcctgagagccgaggacacggctgtgtattactgtgcgagagatgaggaattttactcctcgtactactttgactactggggccagggaaccctggtcaccgtctcctca

SEQ ID NO: 386 - DNA, 324 bp, Artificial Sequence; identical to SEQ ID NO: 370
  Synthetic: P1-068750 VL DNA

SEQ ID NO: 387 - DNA, 363 bp, Artificial Sequence
  Synthetic: P1-068738 VH DNA
caggtgcagctggtggagtctgggggaggcgtggtccagcctgggaggtccctgagactctcctgtgcagcgtctggattcaccttcagtgagtatgcccatcactgggtccgccaggctccaggcaaggggctggagtgggtggcaattatatgggatgatggaagtaatcactactatgcagactccgtgaagggccgattcaccatctccagagacaattccaagaacacgctgtatctgcaaatgaacagcctgagagccgaggacacggctgtgtattactgtgcgagagatagtggtttttacgaagattactactttgactactggggccagggaaccctggtcaccgtctcctca

SEQ ID NO: 388 - DNA, 324 bp, Artificial Sequence; identical to SEQ ID NO: 370
  Synthetic: P1-068738 VL DNA

SEQ ID NO: 389 - DNA, 363 bp, Artificial Sequence
  Synthetic: P1-068754 VH DNA
caggtgcagctggtggagtctgggggaggcgtggtccagcctgggaggtccctgagactctcctgtgcagcgtctggattcaccttcagtgactatgacatgcactgggtccgccaggctccaggcaaggggctggagtgggtggcagagatatgggatgatggaagtaataaatactatgcagactccgtgaagggccgattcaccatctccagagacaattccaagaacacgctgtatctgcaaatgaacagcctgagagccgaggacacggctgtgtattactgtgcgagagatagtggttttcactccgattactactttgactactggggccagggaaccctggtcaccgtctcctca

SEQ ID NO: 390 - DNA, 324 bp, Artificial Sequence; identical to SEQ ID NO: 370
  Synthetic: P1-068754 VL DNA

SEQ ID NO: 391 - DNA, 369 bp, Artificial Sequence
  Synthetic: P1-070864 VH DNA
gaggtgcagctggtggagtctgggggaggcttggtacagcctggcaagtccctgagactctcctgtgcagcctctggattcacccttgatgatgaggccatgcactgggtccggcaagctccagggaagggcctggagtgggtctcaggtattaattggaacagtgaagagataggctatgcggactctgtgaagggccgattcaccatctccagagacaacgccaagaactccctgtatctgcaaatgaacagtctgagaactgaggacacggccttgtattactgtgcaaaagttcctgggtatagccatggctggattgacgctgaagatgtctggggccaagggacaatggtcaccgtctcttca

SEQ ID NO: 392 - DNA, 324 bp, Artificial Sequence; identical to SEQ ID NO: 328
  Synthetic: P1-070864 VL DNA

SEQ ID NO: 393 - DNA, 369 bp, Artificial Sequence
  Synthetic: P1-070866 VH DNA
gaggtgcagctggtggagtctgggggaggcttggtacagcctggcaagtccctgagactctcctgtgcagcctctggattcacccttgaggattatgccatgcactgggtccggcaagctccagggaagggcctggagtgggtctcaggtattaattggaacagtgaagagataggctatgcggactctgtgaagggccgattcaccatctccagagacaacgccaagaactccctgtatctgcaaatgaacagtctgagaactgaggacacggccttgtattactgtgcaaaagttcctgggtatagccatggctggattgacgctgaagatgtctggggccaagggacaatggtcaccgtctcttca

SEQ ID NO: 394 - DNA, 324 bp, Artificial Sequence; identical to SEQ ID NO: 328
  Synthetic: P1-070866 VL DNA

SEQ ID NO: 395 - DNA, 369 bp, Artificial Sequence
  Synthetic: P1-070868 VH DNA
gaggtgcagctggtggagtctgggggaggcttggtacagcctggcaagtccctgagactctcctgtgcagcctctggattcacccttgaggatgaggccatgcactgggtccggcaagctccagggaagggcctggagtgggtctcaggtattaattggaacagtgctgagataggctatgcggactctgtgaagggccgattcaccatctccagagacaacgccaagaactccctgtatctgcaaatgaacagtctgagaactgaggacacggccttgtattactgtgcaaaagttcctgggtatagccatggctggattgacgctgaagatgtctggggccaagggacaatggtcaccgtctcttca

SEQ ID NO: 396 - DNA, 324 bp, Artificial Sequence; identical to SEQ ID NO: 328
  Synthetic: P1-070868 VL DNA

SEQ ID NO: 397 - DNA, 369 bp, Artificial Sequence
  Synthetic: P1-070870 VH DNA
gaggtgcagctggtggagtctgggggaggcttggtacagcctggcaagtccctgagactctcctgtgcagcctctggattcacccttgaggatgaggccatgcactgggtccggcaagctccagggaagggcctggagtgggtctcaggtattaattggaacagtgaaaacataggctatgcggactctgtgaagggccgattcaccatctccagagacaacgccaagaactccctgtatctgcaaatgaacagtctgagaactgaggacacggccttgtattactgtgcaaaagttcctgggtatagccatggctggattgacgctgaagatgtctggggccaagggacaatggtcaccgtctcttca

SEQ ID NO: 398 - DNA, 324 bp, Artificial Sequence; identical to SEQ ID NO: 328
  Synthetic: P1-070870 VL DNA

SEQ ID NO: 399 - DNA, 369 bp, Artificial Sequence
  Synthetic: P1-070872 VH DNA
gaggtgcagctggtggagtctgggggaggcttggtacagcctggcaagtccctgagactctcctgtgcagcctctggattcacccttgaggatgaggccatgcactgggtccggcaagctccagggaagggcctggagtgggtctcaggtattaattggaacagtgaagagataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaagatgtctggggccaagggacaatggtcaccgtctcttca

SEQ ID NO: 400 - DNA, 324 bp, Artificial Sequence; identical to SEQ ID NO: 328
  Synthetic: P1-070872 VL DNA

SEQ ID NO: 401 - DNA, 369 bp, Artificial Sequence
  Synthetic: P1-070874 VH DNA
gaggtgcagctggtggagtctgggggaggcttggtacagcctggcaagtccctgagactctcctgtgcagcctctggattcacccttgaggatgaggccatgcactgggtccggcaagctccagggaagggcctggagtgggtctcaggtattaattggaacagtgaagagataggctatgcggactctgtgaagggccgattcaccatctccagagacaacgccaagaactccctgtatctgcaaatgaacagtctgagaactgaggacacggccttgtattactgtgcaaaagttcctgggtatagccatggctggattgacgcttttgatgtctggggccaagggacaatggtcaccgtctcttca

SEQ ID NO: 402 - DNA, 324 bp, Artificial Sequence; identical to SEQ ID NO: 328
  Synthetic: P1-070874 VL DNA

SEQ ID NO: 403 - DNA, 369 bp, Artificial Sequence
  Synthetic: P1-070876 VH DNA
gaggtgcagctggtggagtctgggggaggcttggtacagcctggcaagtccctgagactctcctgtgcagcctctggattcacccttgatgattatgccatgcactgggtccggcaagctccagggaagggcctggagtgggtctcaggtattaattggaacagtgaagagataggctatgcggactctgtgaagggccgattcaccatctccagagacaacgccaagaactccctgtatctgcaaatgaacagtctgagaactgaggacacggccttgtattactgtgcaaaagttcctgggtatagccatggctggattgacgctgaagatgtctggggccaagggacaatggtcaccgtctcttca

SEQ ID NO: 404 - DNA, 324 bp, Artificial Sequence; identical to SEQ ID NO: 328
  Synthetic: P1-070876 VL DNA

SEQ ID NO: 405 - DNA, 369 bp, Artificial Sequence
  Synthetic: P1-070878 VH DNA
gaggtgcagctggtggagtctgggggaggcttggtacagcctggcaagtccctgagactctcctgtgcagcctctggattcacccttgaggatgaggccatgcactgggtccggcaagctccagggaagggcctggagtgggtctcaggtattaattggaacagtgctaacataggctatgcggactctgtgaagggccgattcaccatctccagagacaacgccaagaactccctgtatctgcaaatgaacagtctgagaactgaggacacggccttgtattactgtgcaaaagttcctgggtatagccatggctggattgacgctgaagatgtctggggccaagggacaatggtcaccgtctcttca

SEQ ID NO: 406 - DNA, 324 bp, Artificial Sequence; identical to SEQ ID NO: 328
  Synthetic: P1-070878 VL DNA

SEQ ID NO: 407 - DNA, 369 bp, Artificial Sequence
  Synthetic: P1-070880 VH DNA
gaggtgcagctggtggagtctgggggaggcttggtacagcctggcaagtccctgagactctcctgtgcagcctctggattcacccttgaggatgaggccatgcactgggtccggcaagctccagggaagggcctggagtgggtctcaggtattaattggaacagtgaagagataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgcttttgatgtctggggccaagggacaatggtcaccgtctcttca

SEQ ID NO: 408 - DNA, 324 bp, Artificial Sequence; identical to SEQ ID NO: 328
  Synthetic: P1-070880 VL DNA

SEQ ID NO: 409 - DNA, 369 bp, Artificial Sequence
  Synthetic: P1-070882 VH DNA
gaggtgcagctggtggagtctgggggaggcttggtacagcctggcaagtccctgagactctcctgtgcagcctctggattcacccttgaggattatgccatgcactgggtccggcaagctccagggaagggcctggagtgggtctcaggtattaattggaacagtgctgagataggctatgcggactctgtgaagggccgattcaccatctccagagacaacgccaagaactccctgtatctgcaaatgaacagtctgagaactgaggacacggccttgtattactgtgcaaaagttcctgggtatagccatggctggattgacgctgaagatgtctggggccaagggacaatggtcaccgtctcttca

SEQ ID NO: 410 - DNA, 324 bp, Artificial Sequence; identical to SEQ ID NO: 328
  Synthetic: P1-070882 VL DNA

SEQ ID NO: 411 - DNA, 369 bp, Artificial Sequence
  Synthetic: P1-070884 VH DNA
gaggtgcagctggtggagtctgggggaggcttggtacagcctggcaagtccctgagactctcctgtgcagcctctggattcacccttgaggattatgccatgcactgggtccggcaagctccagggaagggcctggagtgggtctcaggtattaattggaacagtgaaaacataggctatgcggactctgtgaagggccgattcaccatctccagagacaacgccaagaactccctgtatctgcaaatgaacagtctgagaactgaggacacggccttgtattactgtgcaaaagttcctgggtatagccatggctggattgacgctgaagatgtctggggccaagggacaatggtcaccgtctcttca

SEQ ID NO: 412 - DNA, 324 bp, Artificial Sequence; identical to SEQ ID NO: 328
  Synthetic: P1-070884 VL DNA

SEQ ID NO: 413 - DNA, 369 bp, Artificial Sequence
  Synthetic: P1-070886 VH DNA
gaggtgcagctggtggagtctgggggaggcttggtacagcctggcaagtccctgagactctcctgtgcagcctctggattcacccttgaggattatgccatgcactgggtccggcaagctccagggaagggcctggagtgggtctcaggtattaattggaacagtgaagagataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaagatgtctggggccaagggacaatggtcaccgtctcttca

SEQ ID NO: 414 - DNA, 324 bp, Artificial Sequence; identical to SEQ ID NO: 328
  Synthetic: P1-070886 VL DNA

SEQ ID NO: 415 - DNA, 369 bp, Artificial Sequence
  Synthetic: P1-070888 VH DNA
gaggtgcagctggtggagtctgggggaggcttggtacagcctggcaagtccctgagactctcctgtgcagcctctggattcacccttgaggattatgccatgcactgggtccggcaagctccagggaagggcctggagtgggtctcaggtattaattggaacagtgaagagataggctatgcggactctgtgaagggccgattcaccatctccagagacaacgccaagaactccctgtatctgcaaatgaacagtctgagaactgaggacacggccttgtattactgtgcaaaagttcctgggtatagccatggctggattgacgcttttgatgtctggggccaagggacaatggtcaccgtctcttca

SEQ ID NO: 416 - DNA, 324 bp, Artificial Sequence; identical to SEQ ID NO: 328
  Synthetic: P1-070888 VL DNA

SEQ ID NO: 417 - DNA, 369 bp, Artificial Sequence
  Synthetic: P1-070890 VH DNA
gaggtgcagctggtggagtctgggggaggcttggtacagcctggcaagtccctgagactctcctgtgcagcctctggattcacccttgatgatgaggccatgcactgggtccggcaagctccagggaagggcctggagtgggtctcaggtattaattggaacagtgctgagataggctatgcggactctgtgaagggccgattcaccatctccagagacaacgccaagaactccctgtatctgcaaatgaacagtctgagaactgaggacacggccttgtattactgtgcaaaagttcctgggtatagccatggctggattgacgctgaagatgtctggggccaagggacaatggtcaccgtctcttca

SEQ ID NO: 418 - DNA, 324 bp, Artificial Sequence; identical to SEQ ID NO: 328
  Synthetic: P1-070890 VL DNA

SEQ ID NO: 419 - DNA, 369 bp, Artificial Sequence
  Synthetic: P1-070892 VH DNA
gaggtgcagctggtggagtctgggggaggcttggtacagcctggcaagtccctgagactctcctgtgcagcctctggattcacccttgatgatgaggccatgcactgggtccggcaagctccagggaagggcctggagtgggtctcaggtattaattggaacagtgaaaacataggctatgcggactctgtgaagggccgattcaccatctccagagacaacgccaagaactccctgtatctgcaaatgaacagtctgagaactgaggacacggccttgtattactgtgcaaaagttcctgggtatagccatggctggattgacgctgaagatgtctggggccaagggacaatggtcaccgtctcttca

SEQ ID NO: 420 - DNA, 324 bp, Artificial Sequence; identical to SEQ ID NO: 328
  Synthetic: P1-070892 VL DNA

SEQ ID NO: 421 - DNA, 369 bp, Artificial Sequence
  Synthetic: P1-070894 VH DNA
gaggtgcagctggtggagtctgggggaggcttggtacagcctggcaagtccctgagactctcctgtgcagcctctggattcacccttgatgatgaggccatgcactgggtccggcaagctccagggaagggcctggagtgggtctcaggtattaattggaacagtgaagagataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaagatgtctggggccaagggacaatggtcaccgtctcttca

SEQ ID NO: 422 - DNA, 324 bp, Artificial Sequence; identical to SEQ ID NO: 328
  Synthetic: P1-070894 VL DNA

SEQ ID NO: 423 - DNA, 369 bp, Artificial Sequence
  Synthetic: P1-070896 VH DNA
gaggtgcagctggtggagtctgggggaggcttggtacagcctggcaagtccctgagactctcctgtgcagcctctggattcacccttgatgatgaggccatgcactgggtccggcaagctccagggaagggcctggagtgggtctcaggtattaattggaacagtgaagagataggctatgcggactctgtgaagggccgattcaccatctccagagacaacgccaagaactccctgtatctgcaaatgaacagtctgagaactgaggacacggccttgtattactgtgcaaaagttcctgggtatagccatggctggattgacgcttttgatgtctggggccaagggacaatggtcaccgtctcttca

SEQ ID NO: 424 - DNA, 324 bp, Artificial Sequence; identical to SEQ ID NO: 328
  Synthetic: P1-070896 VL DNA

SEQ ID NO: 425 - DNA, 369 bp, Artificial Sequence
  Synthetic: P1-070898 VH DNA
gaggtgcagctggtggagtctgggggaggcttggtacagcctggcaagtccctgagactctcctgtgcagcctctggattcacccttgaggatgaggccatgcactgggtccggcaagctccagggaagggcctggagtgggtctcaggtattaattggaacagtgctgagataggctatgcggactctgtgaagggccgattcaccatctccagagacaacgccaagaactccctgtatctgcaaatgaacagtctgagaactgaggacacggccttgtattactgtgcaaaagttcctgggtatagccatggctggattgacgcttttgatgtctggggccaagggacaatggtcaccgtctcttca

SEQ ID NO: 426 - DNA, 324 bp, Artificial Sequence; identical to SEQ ID NO: 328
  Synthetic: P1-070898 VL DNA

SEQ ID NO: 427 - DNA, 369 bp, Artificial Sequence
  Synthetic: P1-070900 VH DNA
gaggtgcagctggtggagtctgggggaggcttggtacagcctggcaagtccctgagactctcctgtgcagcctctggattcacccttgaggatgaggccatgcactgggtccggcaagctccagggaagggcctggagtgggtctcaggtattaattggaacagtgaaaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaagatgtctggggccaagggacaatggtcaccgtctcttca

SEQ ID NO: 428 - DNA, 324 bp, Artificial Sequence; identical to SEQ ID NO: 328
  Synthetic: P1-070900 VL DNA

SEQ ID NO: 429 - DNA, 369 bp, Artificial Sequence
  Synthetic: P1-070902 VH DNA
gaggtgcagctggtggagtctgggggaggcttggtacagcctggcaagtccctgagactctcctgtgcagcctctggattcacccttgaggatgaggccatgcactgggtccggcaagctccagggaagggcctggagtgggtctcaggtattaattggaacagtgaaaacataggctatgcggactctgtgaagggccgattcaccatctccagagacaacgccaagaactccctgtatctgcaaatgaacagtctgagaactgaggacacggccttgtattactgtgcaaaagttcctgggtatagccatggctggattgacgcttttgatgtctggggccaagggacaatggtcaccgtctcttca

SEQ ID NO: 430 - DNA, 324 bp, Artificial Sequence; identical to SEQ ID NO: 328
  Synthetic: P1-070902 VL DNA

SEQ ID NO: 431 - DNA, 369 bp, Artificial Sequence
  Synthetic: P1-070904 VH DNA
gaggtgcagctggtggagtctgggggaggcttggtacagcctggcaagtccctgagactctcctgtgcagcctctggattcacccttgatgattatgccatgcactgggtccggcaagctccagggaagggcctggagtgggtctcaggtattgattggaacagtgaaaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaagatgactggggccaagggacaatggtcaccgtctcttca

SEQ ID NO: 432 - DNA, 324 bp, Artificial Sequence; identical to SEQ ID NO: 328
  Synthetic: P1-070904 VL DNA

SEQ ID NO: 433 - DNA, 369 bp, Artificial Sequence
  Synthetic: P1-070906 VH DNA
gaggtgcagctggtggagtctgggggaggcttggtacagcctggcaagtccctgagactctcctgtgcagcctctggattcacccttgaggattatgccatgcactgggtccggcaagctccagggaagggcctggagtgggtctcaggtattaattggaacagtgaaaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaagatgactggggccaagggacaatggtcaccgtctcttca

SEQ ID NO: 434 - DNA, 324 bp, Artificial Sequence; identical to SEQ ID NO: 328
  Synthetic: P1-070906 VL DNA

SEQ ID NO: 435 - DNA, 369 bp, Artificial Sequence
  Synthetic: P1-070908 VH DNA
gaggtgcagctggtggagtctgggggaggcttggtacagcctggcaagtccctgagactctcctgtgcagcctctggattcacccttgaggattatgccatgcactgggtccggcaagctccagggaagggcctggagtgggtctcaggtattgattggaacagtgctaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaagatgactggggccaagggacaatggtcaccgtctcttca

SEQ ID NO: 436 - DNA, 324 bp, Artificial Sequence; identical to SEQ ID NO: 328
  Synthetic: P1-070908 VL DNA

SEQ ID NO: 437 - DNA, 369 bp, Artificial Sequence
  Synthetic: P1-070910 VH DNA
gaggtgcagctggtggagtctgggggaggcttggtacagcctggcaagtccctgagactctcctgtgcagcctctggattcacccttgaggattatgccatgcactgggtccggcaagctccagggaagggcctggagtgggtctcaggtattgattggaacagtgaaaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgcttttgatgactggggccaagggacaatggtcaccgtctcttca

SEQ ID NO: 438 - DNA, 324 bp, Artificial Sequence; identical to SEQ ID NO: 328
  Synthetic: P1-070910 VL DNA

SEQ ID NO: 439 - DNA, 369 bp, Artificial Sequence
  Synthetic: P1-070912 VH DNA
gaggtgcagctggtggagtctgggggaggcttggtacagcctggcaagtccctgagactctcctgtgcagcctctggattcacccttgaggattatgccatgcactgggtccggcaagctccagggaagggcctggagtgggtctcaggtattgattggaacagtgaaaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaagatgtctggggccaagggacaatggtcaccgtctcttca

SEQ ID NO: 440 - DNA, 324 bp, Artificial Sequence; identical to SEQ ID NO: 328
  Synthetic: P1-070912 VL DNA

SEQ ID NO: 441 - DNA, 369 bp, Artificial Sequence
  Synthetic: P1-070914 VH DNA
gaggtgcagctggtggagtctgggggaggcttggtacagcctggcaagtccctgagactctcctgtgcagcctctggattcacccttgatgattatgccatgcactgggtccggcaagctccagggaagggcctggagtgggtctcaggtattaattggaacagtgaaaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaagatgactggggccaagggacaatggtcaccgtctcttca

SEQ ID NO: 442 - DNA, 324 bp, Artificial Sequence; identical to SEQ ID NO: 328
  Synthetic: P1-070914 VL DNA

SEQ ID NO: 443 - DNA, 369 bp, Artificial Sequence
  Synthetic: P1-070916 VH DNA
gaggtgcagctggtggagtctgggggaggcttggtacagcctggcaagtccctgagactctcctgtgcagcctctggattcacccttgaggattatgccatgcactgggtccggcaagctccagggaagggcctggagtgggtctcaggtattaattggaacagtgctaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaagatgactggggccaagggacaatggtcaccgtctcttca

SEQ ID NO: 444 - DNA, 324 bp, Artificial Sequence; identical to SEQ ID NO: 328
  Synthetic: P1-070916 VL DNA

SEQ ID NO: 445 - DNA, 369 bp, Artificial Sequence
  Synthetic: P1-070918 VH DNA
gaggtgcagctggtggagtctgggggaggcttggtacagcctggcaagtccctgagactctcctgtgcagcctctggattcacccttgaggattatgccatgcactgggtccggcaagctccagggaagggcctggagtgggtctcaggtattgattggaacagtgctaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgcttttgatgactggggccaagggacaatggtcaccgtctcttca

SEQ ID NO: 446 - DNA, 324 bp, Artificial Sequence; identical to SEQ ID NO: 328
  Synthetic: P1-070918 VL DNA

SEQ ID NO: 447 - DNA, 369 bp, Artificial Sequence
  Synthetic: P1-070920 VH DNA
gaggtgcagctggtggagtctgggggaggcttggtacagcctggcaagtccctgagactctcctgtgcagcctctggattcacccttgaggattatgccatgcactgggtccggcaagctccagggaagggcctggagtgggtctcaggtattgattggaacagtgaaaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgcttttgatgtctggggccaagggacaatggtcaccgtctcttca

SEQ ID NO: 448 - DNA, 324 bp, Artificial Sequence; identical to SEQ ID NO: 328
  Synthetic: P1-070920 VL DNA

SEQ ID NO: 449 - DNA, 369 bp, Artificial Sequence
  Synthetic: P1-070922 VH DNA
gaggtgcagctggtggagtctgggggaggcttggtacagcctggcaagtccctgagactctcctgtgcagcctctggattcacccttgatgattatgccatgcactgggtccggcaagctccagggaagggcctggagtgggtctcaggtattgattggaacagtgctaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaagatgactggggccaagggacaatggtcaccgtctcttca

SEQ ID NO: 450 - DNA, 324 bp, Artificial Sequence; identical to SEQ ID NO: 328
  Synthetic: P1-070922 VL DNA

SEQ ID NO: 451 - DNA, 369 bp, Artificial Sequence
  Synthetic: P1-070924 VH DNA
gaggtgcagctggtggagtctgggggaggcttggtacagcctggcaagtccctgagactctcctgtgcagcctctggattcacccttgatgattatgccatgcactgggtccggcaagctccagggaagggcctggagtgggtctcaggtattgattggaacagtgaaaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgcttttgatgactggggccaagggacaatggtcaccgtctcttca

SEQ ID NO: 452 - DNA, 324 bp, Artificial Sequence; identical to SEQ ID NO: 328
  Synthetic: P1-070924 VL DNA

SEQ ID NO: 453 - DNA, 369 bp, Artificial Sequence
  Synthetic: P1-070926 VH DNA
gaggtgcagctggtggagtctgggggaggcttggtacagcctggcaagtccctgagactctcctgtgcagcctctggattcacccttgatgattatgccatgcactgggtccggcaagctccagggaagggcctggagtgggtctcaggtattgattggaacagtgaaaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaagatgtctggggccaagggacaatggtcaccgtctcttca

SEQ ID NO: 454 - DNA, 324 bp, Artificial Sequence; identical to SEQ ID NO: 328
  Synthetic: P1-070926 VL DNA

SEQ ID NO: 455 - DNA, 369 bp, Artificial Sequence
  Synthetic: P1-070928 VH DNA
gaggtgcagctggtggagtctgggggaggcttggtacagcctggcaagtccctgagactctcctgtgcagcctctggattcacccttgaggattatgccatgcactgggtccggcaagctccagggaagggcctggagtgggtctcaggtattaattggaacagtgaaaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgcttttgatgactggggccaagggacaatggtcaccgtctcttca

SEQ ID NO: 456 - DNA, 324 bp, Artificial Sequence; identical to SEQ ID NO: 328
  Synthetic: P1-070928 VL DNA

SEQ ID NO: 457 - DNA, 369 bp, Artificial Sequence
  Synthetic: P1-070930 VH DNA
gaggtgcagctggtggagtctgggggaggcttggtacagcctggcaagtccctgagactctcctgtgcagcctctggattcacccttgaggattatgccatgcactgggtccggcaagctccagggaagggcctggagtgggtctcaggtattaattggaacagtgaaaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaagatgtctggggccaagggacaatggtcaccgtctcttca

SEQ ID NO: 458 - DNA, 324 bp, Artificial Sequence; identical to SEQ ID NO: 328
  Synthetic: P1-070930 VL DNA

SEQ ID NO: 459 - DNA, 369 bp, Artificial Sequence
  Synthetic: P1-070932 VH DNA
gaggtgcagctggtggagtctgggggaggcttggtacagcctggcaagtccctgagactctcctgtgcagcctctggattcacccttgaggattatgccatgcactgggtccggcaagctccagggaagggcctggagtgggtctcaggtattgattggaacagtgctaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaagatgtctggggccaagggacaatggtcaccgtctcttca

SEQ ID NO: 460 - DNA, 324 bp, Artificial Sequence; identical to SEQ ID NO: 328
  Synthetic: P1-070932 VL DNA

SEQ ID NO: 461 - DNA, 1875 bp, Artificial Sequence
  Synthetic: IgG1.3 heavy chain constant region DNA
gcgtcgaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggcgtcgaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 462 - DNA, 324 bp, Artificial Sequence
  Synthetic: Exemplary light chain constant region DNA
cgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 463 - protein, 123 aa, Artificial Sequence
  Synthetic: P1-068761 VH K16R T84A
EVQLVESGGGLVQPGRSLRLSCAASGFTLEDEAMHWVRQAPGKGLEWVSGINWNSEEIGYADSVKGRFTISRDNAKNSLYLQMNSLRAEDTALYYCAKVPGYSHGWIDAEDVWGQGTMVTVSS

SEQ ID NO: 464 - protein, 123 aa, Artificial Sequence
  Synthetic: P1-068761 VH K16R
EVQLVESGGGLVQPGRSLRLSCAASGFTLEDEAMHWVRQAPGKGLEWVSGINWNSEEIGYADSVKGRFTISRDNAKNSLYLQMNSLRTEDTALYYCAKVPGYSHGWIDAEDVWGQGTMVTVSS

SEQ ID NO: 465 - protein, 123 aa, Artificial Sequence
  Synthetic: P1-068761 VH T84A
EVQLVESGGGLVQPGKSLRLSCAASGFTLEDEAMHWVRQAPGKGLEWVSGINWNSEEIGYADSVKGRFTISRDNAKNSLYLQMNSLRAEDTALYYCAKVPGYSHGWIDAEDVWGQGTMVTVSS

SEQ ID NO: 466 - DNA, 369 bp, Artificial Sequence
  Synthetic: P1-068761 K16R T84A DNA
gaggtgcagctggtggagtctgggggaggcttggtacagcctggcaggtccctgagactctcctgtgcagcctctggattcacccttgaggatgaggccatgcactgggtccggcaagctccagggaagggcctggagtgggtctcaggtattaattggaacagtgaagagataggctatgcggactctgtgaagggccgattcaccatctccagagacaacgccaagaactccctgtatctgcaaatgaacagtctgagagctgaggacacggccttgtattactgtgcaaaagttcctgggtatagccatggctggattgacgctgaagatgtctggggccaagggacaatggtcaccgtctcttca

SEQ ID NO: 467 - protein, 123 aa, Artificial Sequence
  Synthetic: P1-061029 VH K16R T84A
EVQLVESGGGLVQPGRSLRLSCAASGFTLDDYAMHWVRQAPGKGLEWVSGINWNSANIGYADSVKGRFTISRDNAKNSLYLQMNSLRAEDTALYYCAKVPGYSGGWIDAFDVWGQGTMVTVSS

SEQ ID NO: 468 - protein, 123 aa, Artificial Sequence
  Synthetic: P1-061029 VH K16R
EVQLVESGGGLVQPGRSLRLSCAASGFTLDDYAMHWVRQAPGKGLEWVSGINWNSANIGYADSVKGRFTISRDNAKNSLYLQMNSLRTEDTALYYCAKVPGYSGGWIDAFDVWGQGTMVTVSS

SEQ ID NO: 469 - protein, 123 aa, Artificial Sequence
  Synthetic: P1-061029 VH T84A
EVQLVESGGGLVQPGKSLRLSCAASGFTLDDYAMHWVRQAPGKGLEWVSGINWNSANIGYADSVKGRFTISRDNAKNSLYLQMNSLRAEDTALYYCAKVPGYSGGWIDAFDVWGQGTMVTVSS

SEQ ID NO: 470 - DNA, 369 bp, Artificial Sequence
  Synthetic: P1-061029 VH K16R T84A DNA
gaggtgcagctggtggagtctgggggaggcttggtacagcctggcaggtccctgagactctcctgtgcagcctctggattcacccttgatgattatgccatgcactgggtccggcaagctccagggaagggcctggagtgggtctcaggtattaattggaacagtgctaacataggctatgcggactctgtgaagggccgattcaccatctccagagacaacgccaagaactccctgtatctgcaaatgaacagtctgagagctgaggacacggccttgtattactgtgcaaaagttcctgggtatagcggtggctggattgacgcttttgatgtctggggccaagggacaatggtcaccgtctcttca

SEQ ID NO: 471 - protein, 123 aa, Artificial Sequence
  Synthetic: P1-068767 VH K16R T84A
EVQLVESGGGLVQPGRSLRLSCAASGFTLEDYAMHWVRQAPGKGLEWVSGIDWNSENIGYADSVKGRFTISRDNAKNSLYLQMNSLRAEDTALYYCAKVPGYSGGWIDAEDDWGQGTMVTVSS

SEQ ID NO: 472 - protein, 123 aa, Artificial Sequence
  Synthetic: P1-068767 VH K16R
EVQLVESGGGLVQPGRSLRLSCAASGFTLEDYAMHWVRQAPGKGLEWVSGIDWNSENIGYADSVKGRFTISRDNAKNSLYLQMNSLRTEDTALYYCAKVPGYSGGWIDAEDDWGQGTMVTVSS

SEQ ID NO: 473 - protein, 123 aa, Artificial Sequence
  Synthetic: P1-068767 VH T84A
EVQLVESGGGLVQPGKSLRLSCAASGFTLEDYAMHWVRQAPGKGLEWVSGIDWNSENIGYADSVKGRFTISRDNAKNSLYLQMNSLRAEDTALYYCAKVPGYSGGWIDAEDDWGQGTMVTVSS

SEQ ID NO: 474 - DNA, 369 bp, Artificial Sequence
  Synthetic: P1-068767 VH K16R T84A DNA
gaggtgcagctggtggagtctgggggaggcttggtacagcctggcaggtccctgagactctcctgtgcagcctctggattcacccttgaggattatgccatgcactgggtccggcaagctccagggaagggcctggagtgggtctcaggtattgattggaacagtgaaaacataggctatgcggactctgtgaagggccgattcaccatctccagagacaacgccaagaactccctgtatctgcaaatgaacagtctgagagctgaggacacggccttgtattactgtgcaaaagttcctgggtatagcggtggctggattgacgctgaagatgactggggccaagggacaatggtcaccgtctcttca

SEQ ID NO: 475 - protein, 123 aa, Artificial Sequence
  Synthetic: P1-070868 (P1-068761_E55A) VH K16R T84A
EVQLVESGGGLVQPGRSLRLSCAASGFTLEDEAMHWVRQAPGKGLEWVSGINWNSAEIGYADSVKGRFTISRDNAKNSLYLQMNSLRAEDTALYYCAKVPGYSHGWIDAEDVWGQGTMVTVSS

SEQ ID NO: 476 - protein, 123 aa, Artificial Sequence
  Synthetic: P1-070868 VH K16R
EVQLVESGGGLVQPGRSLRLSCAASGFTLEDEAMHWVRQAPGKGLEWVSGINWNSAEIGYADSVKGRFTISRDNAKNSLYLQMNSLRTEDTALYYCAKVPGYSHGWIDAEDVWGQGTMVTVSS

SEQ ID NO: 477 - protein, 123 aa, Artificial Sequence
  Synthetic: P1-070868 VH T84A
EVQLVESGGGLVQPGKSLRLSCAASGFTLEDEAMHWVRQAPGKGLEWVSGINWNSAEIGYADSVKGRFTISRDNAKNSLYLQMNSLRAEDTALYYCAKVPGYSHGWIDAEDVWGQGTMVTVSS

SEQ ID NO: 478 - DNA, 369 bp, Artificial Sequence; identical to SEQ ID NO: 474
  Synthetic: P1-070868 VH K16R T84A DNA

SEQ ID NO: 479 - protein, 123 aa, Artificial Sequence
  Synthetic: P1-70906 (P1-068767_D52N) VH K16R T84A
EVQLVESGGGLVQPGRSLRLSCAASGFTLEDYAMHWVRQAPGKGLEWVSGINWNSENIGYADSVKGRFTISRDNAKNSLYLQMNSLRAEDTALYYCAKVPGYSGGWIDAEDDWGQGTMVTVSS

SEQ ID NO: 480 - protein, 123 aa, Artificial Sequence
  Synthetic: P1-70906 VH K16R
EVQLVESGGGLVQPGRSLRLSCAASGFTLEDYAMHWVRQAPGKGLEWVSGINWNSENIGYADSVKGRFTISRDNAKNSLYLQMNSLRTEDTALYYCAKVPGYSGGWIDAEDDWGQGTMVTVSS

SEQ ID NO: 481 - protein, 123 aa, Artificial Sequence
  Synthetic: P1-70906 VH T84A
EVQLVESGGGLVQPGKSLRLSCAASGFTLEDYAMHWVRQAPGKGLEWVSGINWNSENIGYADSVKGRFTISRDNAKNSLYLQMNSLRAEDTALYYCAKVPGYSGGWIDAEDDWGQGTMVTVSS

SEQ ID NO: 482 - DNA, 369 bp, Artificial Sequence
  Synthetic: P1-70906 VH K16R T84A DNA
gaggtgcagctggtggagtctgggggaggcttggtacagcctggcaggtccctgagactctcctgtgcagcctctggattcacccttgaggattatgccatgcactgggtccggcaagctccagggaagggcctggagtgggtctcaggtattaattggaacagtgaaaacataggctatgcggactctgtgaagggccgattcaccatctccagagacaacgccaagaactccctgtatctgcaaatgaacagtctgagagctgaggacacggccttgtattactgtgcaaaagttcctgggtatagcggtggctggattgacgctgaagatgactggggccaagggacaatggtcaccgtctcttca

SEQ ID NO: 483 - protein, 123 aa, Artificial Sequence
  Synthetic: P1-70908 (P1-068767_E55A) VH K16R T84A
EVQLVESGGGLVQPGRSLRLSCAASGFTLEDYAMHWVRQAPGKGLEWVSGIDWNSANIGYADSVKGRFTISRDNAKNSLYLQMNSLRAEDTALYYCAKVPGYSGGWIDAEDDWGQGTMVTVSS

SEQ ID NO: 484 - protein, 123 aa, Artificial Sequence
  Synthetic: P1-70908 VH K16R
EVQLVESGGGLVQPGRSLRLSCAASGFTLEDYAMHWVRQAPGKGLEWVSGIDWNSANIGYADSVKGRFTISRDNAKNSLYLQMNSLRTEDTALYYCAKVPGYSGGWIDAEDDWGQGTMVTVSS

SEQ ID NO: 485 - protein, 123 aa, Artificial Sequence
  Synthetic: P1-70908 VH T84A
EVQLVESGGGLVQPGKSLRLSCAASGFTLEDYAMHWVRQAPGKGLEWVSGIDWNSANIGYADSVKGRFTISRDNAKNSLYLQMNSLRAEDTALYYCAKVPGYSGGWIDAEDDWGQGTMVTVSS

SEQ ID NO: 486 - DNA, 369 bp, Artificial Sequence
  Synthetic: P1-70908 VH K16R T84A DNA
gaggtgcagctggtggagtctgggggaggcttggtacagcctggcaggtccctgagactctcctgtgcagcctctggattcacccttgaggattatgccatgcactgggtccggcaagctccagggaagggcctggagtgggtctcaggtattgattggaacagtgctaacataggctatgcggactctgtgaagggccgattcaccatctccagagacaacgccaagaactccctgtatctgcaaatgaacagtctgagagctgaggacacggccttgtattactgtgcaaaagttcctgggtatagcggtggctggattgacgctgaagatgactggggccaagggacaatggtcaccgtctcttca

SEQ ID NO: 487 - protein, 123 aa, Artificial Sequence
  Synthetic: P1-70916 (P1-068767_D52N_E55A) VH K16R T84A
EVQLVESGGGLVQPGRSLRLSCAASGFTLEDYAMHWVRQAPGKGLEWVSGINWNSANIGYADSVKGRFTISRDNAKNSLYLQMNSLRAEDTALYYCAKVPGYSGGWIDAEDDWGQGTMVTVSS

SEQ ID NO: 488 - protein, 123 aa, Artificial Sequence
  Synthetic: P1-70916 VH K16R
EVQLVESGGGLVQPGRSLRLSCAASGFTLEDYAMHWVRQAPGKGLEWVSGINWNSANIGYADSVKGRFTISRDNAKNSLYLQMNSLRTEDTALYYCAKVPGYSGGWIDAEDDWGQGTMVTVSS

SEQ ID NO: 489 - protein, 123 aa, Artificial Sequence
  Synthetic: P1-70916 VH T84A
EVQLVESGGGLVQPGKSLRLSCAASGFTLEDYAMHWVRQAPGKGLEWVSGINWNSANIGYADSVKGRFTISRDNAKNSLYLQMNSLRAEDTALYYCAKVPGYSGGWIDAEDDWGQGTMVTVSS

SEQ ID NO: 490 - DNA, 369 bp, Artificial Sequence
  Synthetic: P1-70916 VH K16R T84A DNA
gaggtgcagctggtggagtctgggggaggcttggtacagcctggcaggtccctgagactctcctgtgcagcctctggattcacccttgaggattatgccatgcactgggtccggcaagctccagggaagggcctggagtgggtctcaggtattaattggaacagtgctaacataggctatgcggactctgtgaagggccgattcaccatctccagagacaacgccaagaactccctgtatctgcaaatgaacagtctgagagctgaggacacggccttgtattactgtgcaaaagttcctgggtatagcggtggctggattgacgctgaagatgactggggccaagggacaatggtcaccgtctcttca

SEQ ID NO: 491 - protein, 123 aa, Artificial Sequence
  Synthetic: P1-72000 (P1-061029_F100fE_V102D) VH
EVQLVESGGGLVQPGKSLRLSCAASGFTLDDYAMHWVRQAPGKGLEWVSGINWNSANIGYADSVKGRFTISRDNAKNSLYLQMNSLRTEDTALYYCAKVPGYSGGWIDAEDDWGQGTMVTVSS

SEQ ID NO: 492 - protein, 108 aa, Artificial Sequence; identical to SEQ ID NO: 12
  Synthetic: P1-72000 (P1-061029_F100fE_V102D) VL

SEQ ID NO: 493 - protein, 452 aa, Artificial Sequence
  Synthetic: P1-72000 (P1-061029_F100fE_V102D) HC
EVQLVESGGGLVQPGKSLRLSCAASGFTLDDYAMHWVRQAPGKGLEWVSGINWNSANIGYADSVKGRFTISRDNAKNSLYLQMNSLRTEDTALYYCAKVPGYSGGWIDAEDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 494 - protein, 215 aa, Artificial Sequence; identical to SEQ ID NO: 14
  Synthetic: P1-72000 (P1-061029_F100fE_V102D) LC

SEQ ID NO: 495 - DNA, 369 bp, Artificial Sequence
  Synthetic: P1-72000 (P1-061029_F100fE_V102D) VH DNA
gaggtgcagctggtggagtctgggggaggcttggtacagcctggcaagtccctgagactctcctgtgcagcctctggattcacccttgatgattatgccatgcactgggtccggcaagctccagggaagggcctggagtgggtctcaggtattaattggaacagtgctaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaggatgactggggccaagggacaatggtcaccgtctcttca

SEQ ID NO: 496 - DNA, 324 bp, Artificial Sequence; identical to SEQ ID NO: 328
  Synthetic: P1-72000 (P1-061029_F100fE_V102D) VL DNA

SEQ ID NO: 497 - DNA, 1359 bp, Artificial Sequence
  Synthetic: P1-72000 (P1-061029_F100fE_V102D) HC DNA
gaggtgcagctggtggagtctgggggaggcttggtacagcctggcaagtccctgagactctcctgtgcagcctctggattcacccttgatgattatgccatgcactgggtccggcaagctccagggaagggcctggagtgggtctcaggtattaattggaacagtgctaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaggatgactggggccaagggacaatggtcaccgtctcttcagcgtcgaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 498 - DNA, 648 bp, Artificial Sequence
  Synthetic: P1-72000 (P1-061029_F100fE_V102D) LC DNA
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccattcactttcggccctgggaccaaagtggatatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 499 - protein, 123 aa, Artificial Sequence
  Synthetic: P1-72000 (P1-061029_F100fE_V102D) VH K16R T84A
EVQLVESGGGLVQPGRSLRLSCAASGFTLDDYAMHWVRQAPGKGLEWVSGINWNSANIGYADSVKGRFTISRDNAKNSLYLQMNSLRAEDTALYYCAKVPGYSGGWIDAEDDWGQGTMVTVSS

SEQ ID NO: 500 - protein, 123 aa, Artificial Sequence
  Synthetic: P1-72000 (P1-061029_F100fE_V102D) VH K16R
EVQLVESGGGLVQPGRSLRLSCAASGFTLDDYAMHWVRQAPGKGLEWVSGINWNSANIGYADSVKGRFTISRDNAKNSLYLQMNSLRTEDTALYYCAKVPGYSGGWIDAEDDWGQGTMVTVSS

SEQ ID NO: 501 - protein, 123 aa, Artificial Sequence
  Synthetic: P1-72000 (P1-061029_F100fE_V102D) VH T84A
EVQLVESGGGLVQPGKSLRLSCAASGFTLDDYAMHWVRQAPGKGLEWVSGINWNSANIGYADSVKGRFTISRDNAKNSLYLQMNSLRAEDTALYYCAKVPGYSGGWIDAEDDWGQGTMVTVSS

SEQ ID NO: 502 - DNA, 369 bp, Artificial Sequence
  Synthetic: P1-72000 (P1-061029_F100fE_V102D) VH K16R T84A DNA
gaggtgcagctggtggagtctgggggaggcttggtacagcctggcaggtccctgagactctcctgtgcagcctctggattcacccttgatgattatgccatgcactgggtccggcaagctccagggaagggcctggagtgggtctcaggtattaattggaacagtgctaacataggctatgcggactctgtgaagggccgattcaccatctccagagacaacgccaagaactccctgtatctgcaaatgaacagtctgagagctgaggacacggccttgtattactgtgcaaaagttcctgggtatagcggtggctggattgacgctgaggatgactggggccaagggacaatggtcaccgtctcttca

SEQ ID NO: 503 - protein, 123 aa, Artificial Sequence
  Synthetic: P1-72002 (P1-061029_F100fE) VH
EVQLVESGGGLVQPGKSLRLSCAASGFTLDDYAMHWVRQAPGKGLEWVSGINWNSANIGYADSVKGRFTISRDNAKNSLYLQMNSLRTEDTALYYCAKVPGYSGGWIDAEDVWGQGTMVTVSS

SEQ ID NO: 504 - protein, 108 aa, Artificial Sequence; identical to SEQ ID NO: 12
  Synthetic: P1-72002 (P1-061029_F100fE) VL

SEQ ID NO: 505 - protein, 452 aa, Artificial Sequence
  Synthetic: P1-72002 (P1-061029_F100fE) HC
EVQLVESGGGLVQPGKSLRLSCAASGFTLDDYAMHWVRQAPGKGLEWVSGINWNSANIGYADSVKGRFTISRDNAKNSLYLQMNSLRTEDTALYYCAKVPGYSGGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 506 - protein, 215 aa, Artificial Sequence; identical to SEQ ID NO: 14
  Synthetic: P1-72002 (P1-061029_F100fE) LC

SEQ ID NO: 507 - DNA, 369 bp, Artificial Sequence
  Synthetic: P1-72002 (P1-061029_F100fE) VH DNA
gaggtgcagctggtggagtctgggggaggcttggtacagcctggcaagtccctgagactctcctgtgcagcctctggattcacccttgatgattatgccatgcactgggtccggcaagctccagggaagggcctggagtgggtctcaggtattaattggaacagtgctaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaggatgtctggggccaagggacaatggtcaccgtctcttca

SEQ ID NO: 508 - DNA, 324 bp, Artificial Sequence; identical to SEQ ID NO: 328
  Synthetic: P1-72002 (P1-061029_F100fE) VL DNA

SEQ ID NO: 509 - DNA, 1359 bp, Artificial Sequence
  Synthetic: P1-72002 (P1-061029_F100fE) HC DNA
gaggtgcagctggtggagtctgggggaggcttggtacagcctggcaagtccctgagactctcctgtgcagcctctggattcacccttgatgattatgccatgcactgggtccggcaagctccagggaagggcctggagtgggtctcaggtattaattggaacagtgctaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaggatgtctggggccaagggacaatggtcaccgtctcttcagcgtcgaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 510 - DNA, 648 bp, Artificial Sequence; identical to SEQ ID NO: 498
  Synthetic: P1-72002 (P1-061029_F100fE) LC DNA

SEQ ID NO: 511 - protein, 123 aa, Artificial Sequence
  Synthetic: P1-72002 (P1-061029_F100fE) VH K16R T84A
EVQLVESGGGLVQPGRSLRLSCAASGFTLDDYAMHWVRQAPGKGLEWVSGINWNSANIGYADSVKGRFTISRDNAKNSLYLQMNSLRAEDTALYYCAKVPGYSGGWIDAEDVWGQGTMVTVSS

SEQ ID NO: 512 - protein, 123 aa, Artificial Sequence
  Synthetic: P1-72002 (P1-061029_F100fE) VH K16R
EVQLVESGGGLVQPGRSLRLSCAASGFTLDDYAMHWVRQAPGKGLEWVSGINWNSANIGYADSVKGRFTISRDNAKNSLYLQMNSLRTEDTALYYCAKVPGYSGGWIDAEDVWGQGTMVTVSS

SEQ ID NO: 513 - protein, 123 aa, Artificial Sequence; identical to SEQ ID NO: 501
  Synthetic: P1-72002 (P1-061029_F100fE) VH T84A

SEQ ID NO: 514 - DNA, 369 bp, Artificial Sequence
  Synthetic: P1-72002 (P1-061029_F100fE) VH K16R T84A DNA
gaggtgcagctggtggagtctgggggaggcttggtacagcctggcaggtccctgagactctcctgtgcagcctctggattcacccttgatgattatgccatgcactgggtccggcaagctccagggaagggcctggagtgggtctcaggtattaattggaacagtgctaacataggctatgcggactctgtgaagggccgattcaccatctccagagacaacgccaagaactccctgtatctgcaaatgaacagtctgagagctgaggacacggccttgtattactgtgcaaaagttcctgggtatagcggtggctggattgacgctgaggatgtctggggccaagggacaatggtcaccgtctcttca

SEQ ID NO: 515 - protein, 123 aa, Artificial Sequence
  Synthetic: P1-72004 (P1-061029_V102D) VH
EVQLVESGGGLVQPGKSLRLSCAASGFTLDDYAMHWVRQAPGKGLEWVSGINWNSANIGYADSVKGRFTISRDNAKNSLYLQMNSLRTEDTALYYCAKVPGYSGGWIDAFDDWGQGTMVTVSS

SEQ ID NO: 516 - protein, 108 aa, Artificial Sequence; identical to SEQ ID NO: 12
  Synthetic: P1-72004 (P1-061029_ V102D) VL

SEQ ID NO: 517 - protein, 452 aa, Artificial Sequence
  Synthetic: P1-72004 (P1-061029_ V102D) HC
EVQLVESGGGLVQPGKSLRLSCAASGFTLDDYAMHWVRQAPGKGLEWVSGINWNSANIGYADSVKGRFTISRDNAKNSLYLQMNSLRTEDTALYYCAKVPGYSGGWIDAFDDWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 518 - protein, 215 aa, Artificial Sequence; identical to SEQ ID NO: 14
  Synthetic: P1-72004 (P1-061029_ V102D) LC

SEQ ID NO: 519 - DNA, 369 bp, Artificial Sequence
  Synthetic: P1-72004 (P1-061029_ V102D) VH DNA
gaggtgcagctggtggagtctgggggaggcttggtacagcctggcaagtccctgagactctcctgtgcagcctctggattcacccttgatgattatgccatgcactgggtccggcaagctccagggaagggcctggagtgggtctcaggtattaattggaacagtgctaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgcttttgatgactggggccaagggacaatggtcaccgtctcttca

SEQ ID NO: 520 - DNA, 324 bp, Artificial Sequence; identical to SEQ ID NO: 328
  Synthetic: P1-72004 (P1-061029_ V102D) VL DNA

SEQ ID NO: 521 - DNA, 1359 bp, Artificial Sequence
  Synthetic: P1-72004 (P1-061029_ V102D) HC DNA
gaggtgcagctggtggagtctgggggaggcttggtacagcctggcaagtccctgagactctcctgtgcagcctctggattcacccttgatgattatgccatgcactgggtccggcaagctccagggaagggcctggagtgggtctcaggtattaattggaacagtgctaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgcttttgatgactggggccaagggacaatggtcaccgtctcttcagcgtcgaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 522 - DNA, 648 bp, Artificial Sequence; identical to SEQ ID NO: 498
  Synthetic: P1-72004 (P1-061029_ V102D) LC DNA

SEQ ID NO: 523 - protein, 123 aa, Artificial Sequence
  Synthetic: P1-72004 (P1-061029_ V102D) VH K16R T84A
EVQLVESGGGLVQPGRSLRLSCAASGFTLDDYAMHWVRQAPGKGLEWVSGINWNSANIGYADSVKGRFTISRDNAKNSLYLQMNSLRAEDTALYYCAKVPGYSGGWIDAFDDWGQGTMVTVSS

SEQ ID NO: 524 - protein, 123 aa, Artificial Sequence
  Synthetic: P1-72004 (P1-061029_ V102D) VH K16R
EVQLVESGGGLVQPGRSLRLSCAASGFTLDDYAMHWVRQAPGKGLEWVSGINWNSANIGYADSVKGRFTISRDNAKNSLYLQMNSLRTEDTALYYCAKVPGYSGGWIDAFDDWGQGTMVTVSS

SEQ ID NO: 525 - protein, 123 aa, Artificial Sequence
  Synthetic: P1-72004 (P1-061029_ V102D) VH T84A
EVQLVESGGGLVQPGKSLRLSCAASGFTLDDYAMHWVRQAPGKGLEWVSGINWNSANIGYADSVKGRFTISRDNAKNSLYLQMNSLRAEDTALYYCAKVPGYSGGWIDAFDDWGQGTMVTVSS

SEQ ID NO: 526 - DNA, 369 bp, Artificial Sequence
  Synthetic: P1-72004 (P1-061029_ V102D) VH K16R T84A DNA
gaggtgcagctggtggagtctgggggaggcttggtacagcctggcaggtccctgagactctcctgtgcagcctctggattcacccttgatgattatgccatgcactgggtccggcaagctccagggaagggcctggagtgggtctcaggtattaattggaacagtgctaacataggctatgcggactctgtgaagggccgattcaccatctccagagacaacgccaagaactccctgtatctgcaaatgaacagtctgagagctgaggacacggccttgtattactgtgcaaaagttcctgggtatagcggtggctggattgacgcttttgatgactggggccaagggacaatggtcaccgtctcttca

SEQ ID NO: 527 - protein, 123 aa, Artificial Sequence
  Synthetic: P1-72006 (P1-061029_Y32E) VH
EVQLVESGGGLVQPGKSLRLSCAASGFTLDDEAMHWVRQAPGKGLEWVSGINWNSANIGYADSVKGRFTISRDNAKNSLYLQMNSLRTEDTALYYCAKVPGYSGGWIDAFDVWGQGTMVTVSS

SEQ ID NO: 528 - protein, 108 aa, Artificial Sequence; identical to SEQ ID NO: 12
  Synthetic: P1-72006 (P1-061029_ Y32E) VL

SEQ ID NO: 529 - protein, 452 aa, Artificial Sequence
  Synthetic: P1-72006 (P1-061029_ Y32E) HC
EVQLVESGGGLVQPGKSLRLSCAASGFTLDDEAMHWVRQAPGKGLEWVSGINWNSANIGYADSVKGRFTISRDNAKNSLYLQMNSLRTEDTALYYCAKVPGYSGGWIDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 530 - protein, 215 aa, Artificial Sequence; identical to SEQ ID NO: 14
  Synthetic: P1-72006 (P1-061029_ Y32E) LC

SEQ ID NO: 531 - DNA, 369 bp, Artificial Sequence
  Synthetic: P1-72006 (P1-061029_ Y32E) VH DNA
gaggtgcagctggtggagtctgggggaggcttggtacagcctggcaagtccctgagactctcctgtgcagcctctggattcacccttgatgatgaggccatgcactgggtccggcaagctccagggaagggcctggagtgggtctcaggtattaattggaacagtgctaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgcttttgatgtctggggccaagggacaatggtcaccgtctcttca

SEQ ID NO: 532 - DNA, 324 bp, Artificial Sequence; identical to SEQ ID NO: 328
  Synthetic: P1-72006 (P1-061029_ Y32E) VL DNA

SEQ ID NO: 533 - DNA, 1359 bp, Artificial Sequence
  Synthetic: P1-72006 (P1-061029_ Y32E) HC DNA
gaggtgcagctggtggagtctgggggaggcttggtacagcctggcaagtccctgagactctcctgtgcagcctctggattcacccttgatgatgaggccatgcactgggtccggcaagctccagggaagggcctggagtgggtctcaggtattaattggaacagtgctaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgcttttgatgtctggggccaagggacaatggtcaccgtctcttcagcgtcgaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 534 - DNA, 648 bp, Artificial Sequence; identical to SEQ ID NO: 498
  Synthetic: P1-72006 (P1-061029_ Y32E) LC DNA

SEQ ID NO: 535 - protein, 123 aa, Artificial Sequence
  Synthetic: P1-72006 (P1-061029_ Y32E) VH K16R T84A
EVQLVESGGGLVQPGRSLRLSCAASGFTLDDEAMHWVRQAPGKGLEWVSGINWNSANIGYADSVKGRFTISRDNAKNSLYLQMNSLRAEDTALYYCAKVPGYSGGWIDAFDVWGQGTMVTVSS

SEQ ID NO: 536 - protein, 123 aa, Artificial Sequence
  Synthetic: P1-72006 (P1-061029_ Y32E) VH K16R
EVQLVESGGGLVQPGRSLRLSCAASGFTLDDEAMHWVRQAPGKGLEWVSGINWNSANIGYADSVKGRFTISRDNAKNSLYLQMNSLRTEDTALYYCAKVPGYSGGWIDAFDVWGQGTMVTVSS

SEQ ID NO: 537 - protein, 123 aa, Artificial Sequence
  Synthetic: P1-72006 (P1-061029_ Y32E) VH T84A
EVQLVESGGGLVQPGKSLRLSCAASGFTLDDEAMHWVRQAPGKGLEWVSGINWNSANIGYADSVKGRFTISRDNAKNSLYLQMNSLRAEDTALYYCAKVPGYSGGWIDAFDVWGQGTMVTVSS

SEQ ID NO: 538 - DNA, 369 bp, Artificial Sequence
  Synthetic: P1-72006 (P1-061029_ Y32E) VH K16R T84A DNA
gaggtgcagctggtggagtctgggggaggcttggtacagcctggcaggtccctgagactctcctgtgcagcctctggattcacccttgatgatgaggccatgcactgggtccggcaagctccagggaagggcctggagtgggtctcaggtattaattggaacagtgctaacataggctatgcggactctgtgaagggccgattcaccatctccagagacaacgccaagaactccctgtatctgcaaatgaacagtctgagagctgaggacacggccttgtattactgtgcaaaagttcctgggtatagcggtggctggattgacgcttttgatgtctggggccaagggacaatggtcaccgtctcttca

SEQ ID NO: 539 - protein, 123 aa, Artificial Sequence
  Synthetic: P1-72008 (P1-061029_Y32E_F100fE) VH
EVQLVESGGGLVQPGKSLRLSCAASGFTLDDEAMHWVRQAPGKGLEWVSGINWNSANIGYADSVKGRFTISRDNAKNSLYLQMNSLRTEDTALYYCAKVPGYSGGWIDAEDVWGQGTMVTVSS

SEQ ID NO: 540 - protein, 108 aa, Artificial Sequence; identical to SEQ ID NO: 12
  Synthetic: P1-72008 (P1-061029_ Y32E_F100fE) VL

SEQ ID NO: 541 - protein, 452 aa, Artificial Sequence
  Synthetic: P1-72008 (P1-061029_ Y32E_F100fE) HC
EVQLVESGGGLVQPGKSLRLSCAASGFTLDDEAMHWVRQAPGKGLEWVSGINWNSANIGYADSVKGRFTISRDNAKNSLYLQMNSLRTEDTALYYCAKVPGYSGGWIDAEDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 542 - protein, 215 aa, Artificial Sequence; identical to SEQ ID NO: 14
  Synthetic: P1-72008 (P1-061029_ Y32E_F100fE) LC

SEQ ID NO: 543 - DNA, 369 bp, Artificial Sequence
  Synthetic: P1-72008 (P1-061029_ Y32E_F100fE) VH DNA
gaggtgcagctggtggagtctgggggaggcttggtacagcctggcaagtccctgagactctcctgtgcagcctctggattcacccttgatgatgaggccatgcactgggtccggcaagctccagggaagggcctggagtgggtctcaggtattaattggaacagtgctaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaggatgtctggggccaagggacaatggtcaccgtctcttca

SEQ ID NO: 544 - DNA, 324 bp, Artificial Sequence; identical to SEQ ID NO: 328
  Synthetic: P1-72008 (P1-061029_ Y32E_F100fE) VL DNA

SEQ ID NO: 545 - DNA, 1359 bp, Artificial Sequence
  Synthetic: P1-72008 (P1-061029_ Y32E_F100fE) HC DNA
gaggtgcagctggtggagtctgggggaggcttggtacagcctggcaagtccctgagactctcctgtgcagcctctggattcacccttgatgatgaggccatgcactgggtccggcaagctccagggaagggcctggagtgggtctcaggtattaattggaacagtgctaacataggctatgcggactctgtgaagggccgattcaccatctccagagacaacgccaagaactccctgtatctgcaaatgaacagtctgagaactgaggacacggccttgtattactgtgcaaaagttcctgggtatagcggtggctggattgacgctgaggatgtctggggccaagggacaatggtcaccgtctcttcagcgtcgaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 546 - DNA, 648 bp, Artificial Sequence; identical to SEQ ID NO: 498
  Synthetic: P1-72008 (P1-061029_ Y32E_F100fE) LC DNA

SEQ ID NO: 547 - protein, 123 aa, Artificial Sequence
  Synthetic: P1-72008 (P1-061029_ Y32E_F100fE) VH K16R T84A
EVQLVESGGGLVQPGRSLRLSCAASGFTLDDEAMHWVRQAPGKGLEWVSGINWNSANIGYADSVKGRFTISRDNAKNSLYLQMNSLRAEDTALYYCAKVPGYSGGWIDAEDVWGQGTMVTVSS

SEQ ID NO: 548 - protein, 123 aa, Artificial Sequence
  Synthetic: P1-72008 (P1-061029_ Y32E_F100fE) VH K16R
EVQLVESGGGLVQPGRSLRLSCAASGFTLDDEAMHWVRQAPGKGLEWVSGINWNSANIGYADSVKGRFTISRDNAKNSLYLQMNSLRTEDTALYYCAKVPGYSGGWIDAEDVWGQGTMVTVSS

SEQ ID NO: 549 - protein, 123 aa, Artificial Sequence
  Synthetic: P1-72008 (P1-061029_ Y32E_F100fE) VH T84A
EVQLVESGGGLVQPGKSLRLSCAASGFTLDDEAMHWVRQAPGKGLEWVSGINWNSANIGYADSVKGRFTISRDNAKNSLYLQMNSLRAEDTALYYCAKVPGYSGGWIDAEDVWGQGTMVTVSS

SEQ ID NO: 550 - DNA, 369 bp, Artificial Sequence
  Synthetic: P1-72008 (P1-061029_ Y32E_F100fE) VH K16R T84A DNA
gaggtgcagctggtggagtctgggggaggcttggtacagcctggcaggtccctgagactctcctgtgcagcctctggattcacccttgatgatgaggccatgcactgggtccggcaagctccagggaagggcctggagtgggtctcaggtattaattggaacagtgctaacataggctatgcggactctgtgaagggccgattcaccatctccagagacaacgccaagaactccctgtatctgcaaatgaacagtctgagagctgaggacacggccttgtattactgtgcaaaagttcctgggtatagcggtggctggattgacgctgaggatgtctggggccaagggacaatggtcaccgtctcttca

SEQ ID NO: 551 - protein, 137 aa, Artificial Sequence
  Synthetic: VISTA.4 VH  41F11 With signal sequence
MEFGLSWVFLVAIIKGVQCQVQLVESGGGLVKPGGSLRLSCAASGFTFSDYYMSWIRQAPGKGLEWVSYISNSGSPIYYADSVKGRFTISRDNAKNSLYLQMNSLRAEDTAVYYCARDLPGWYFDLWGRGTLVTVSS

SEQ ID NO: 552 - protein, 127 aa, Artificial Sequence
  Synthetic: VISTA.4 VK1 VL 41F11 With signal sequence
MEAPAQLLFLLLLWLPDTTGEIVLTQSPATLSLSPGERATLSCRASQSVSSYLAWYQQKPGQAPRLLIYDASNRATGIPARFSASGSGTDFTLTISSLEPEDFAVYYCQQRNNWPRTFGQGTKVEIK

SEQ ID NO: 553 - protein, 129 aa, Artificial Sequence
  Synthetic: VISTA.4 VK2 VL 41F11 With signal sequence
MDMRVLAQLLGLLLLCFPGARCDIQMTQSPSSLSASVGDRVTITCRASQGISSWLAWYQQKPEKAPKSLIYAASSLQSGVPSRFSGSGSGTDFTLTISSLQPEDFATYYCQQYNSYPRTFGQGTKVEIK

SEQ ID NO: 554 - protein, 128 aa, Artificial Sequence
  Synthetic: VISTA.4 VK3 VL 41F11 With signal sequence
METPAQLLFLLLLWLPDTTGEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 555 - DNA, 411 bp, Artificial Sequence
  Synthetic: VISTA.4 VH DNA 41F11 With signal sequence
atggagtttgggctgagctgggttttccttgttgctattataaaaggtgtccagtgtcaggtgcagttggtggagtctgggggaggcttggtcaagcctggagggtccctgagactctcctgtgcagcctctggattcaccttcagtgactattacatgagctggatccgccaggctccagggaaggggctggagtgggtttcatacattagtaatagtggtagtcccatatactacgcagactctgtgaagggccgattcaccatctccagggacaacgccaagaactcactgtatctgcaaatgaacagcctgagagccgaggacacggccgtgtattactgtgcgagagatctcccgggctggtacttcgatctctggggccgtggcaccctggtcactgtctcctca

SEQ ID NO: 556 - DNA, 381 bp, Artificial Sequence
  Synthetic: VISTA.4 VK1 VL DNA With signal sequence
atggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtgccagtgggtctgggacagacttcactctcaccatcagcagcctagagcctgaagattttgcagtttattactgtcagcagcgtaacaactggcctcggacgttcggccaagggaccaaggtggaaatcaaa

SEQ ID NO: 557 - protein, 127 aa, Artificial Sequence
  Synthetic: VISTA.4.A64G VK1 VL With signal sequence
MEAPAQLLFLLLLWLPDTTGEIVLTQSPATLSLSPGERATLSCRASQSVSSYLAWYQQKPGQAPRLLIYDASNRATGIPARFSGSGSGTDFTLTISSLEPEDFAVYYCQQRNNWPRTFGQGTKVEIK

SEQ ID NO: 558 - protein, 234 aa, Artificial Sequence
  Synthetic: VISTA.4.A64G LC With signal sequence
MEAPAQLLFLLLLWLPDTTGEIVLTQSPATLSLSPGERATLSCRASQSVSSYLAWYQQKPGQAPRLLIYDASNRATGIPARFSGSGSGTDFTLTISSLEPEDFAVYYCQQRNNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 559 - protein, 121 aa, Artificial Sequence
  Synthetic: VISTA.5 VH
AVQLQESGPGLVRPSQSLSLTCTVTDYSITSDYAWNWIRQFPGSKLEWLGFIGYSGNTNYNPSLESRISITRHTSKNQFFLHLNSMTTEDTATYYCARSLYGGSHWYFDVWGAGTTVTVSS

SEQ ID NO: 560 - protein, 111 aa, Artificial Sequence
  Synthetic: VISTA.5 VK1, VL
DIVLTQSPASLAVSLGQRATISCRGSESVEYYGTILMQWYQQKPGQPPKLLIYGASNVESGVPARFSGSGSGTDFSLNIHPVEEDDIAMYFCQQSRKVPWTFGGGTKLEIK

SEQ ID NO: 561 - DNA, 363 bp, Artificial Sequence
  Synthetic: VISTA.5 VH DNA
gctgtgcagcttcaggagtcgggacctggcctggtgagaccttctcagtctctgtccctcacctgcactgtcactgactactcaatcaccagtgattatgcctggaactggatccggcagtttccaggaagcaaactggagtggctgggcttcataggctacagtggtaacactaactacaacccatctctcgaaagtcgaatctctatcactcgacacacatccaagaaccagttcttcctgcacttgaattctatgactactgaggacacagccacatattactgtgcaagatccctctacggtggtagtcactggtacttcgatgtctggggcgcagggaccacggtcaccgtctcctca

SEQ ID NO: 562 - DNA, 333 bp, Artificial Sequence
  Synthetic: VISTA.5 VK1, VL DNA
gacattgtgctcacccaatctccagcttctttggctgtgtctctagggcagagagccaccatctcctgcagaggcagtgaaagtgttgaatattatggcacaattttaatgcagtggtaccaacagaaaccaggacagccacccaaactcctcatctatggtgcatccaacgtagaatctggggtccctgccaggtttagtggcagtgggtctgggacagacttcagcctcaacatccatcctgtggaggaggatgatattgcaatgtatttctgtcagcaaagtaggaaggttccgtggacgttcggtggaggcaccaagctggaaatcaaa

SEQ ID NO: 563 - protein, 10 aa, Artificial Sequence
  Synthetic: CDR1
  misc_feature (4)..(4): X is D or L
  misc_feature (5)..(5): X is E or D
  misc_feature (7)..(7): X is E or Y
GFTXXDXAMH

SEQ ID NO: 564 - protein, 17 aa, Artificial Sequence
  Synthetic: CDR2
  misc_feature (3)..(3): X is D or N
  misc_feature (5)..(5): X is D or N
  misc_feature (7)..(7): X is D, E, H or A
  misc_feature (8)..(8): X is D, E, H or N
GIXWXSXXIGYADSVKG

SEQ ID NO: 565 - protein, 14 aa, Artificial Sequence
  Synthetic: CDR3
  misc_feature (6)..(6): X is E, H or G
  misc_feature (12)..(12): X is E, D or F
  misc_feature (14)..(14): X is D, E or V
VPGYSXGWIDAXDX

SEQ ID NO: 566 - protein, 12 aa, Artificial Sequence
  Synthetic: Region 1
LGPVDKGHDVTF

SEQ ID NO: 567 - protein, 12 aa, Artificial Sequence
  Synthetic: Region 2
RRPIRNLTFQDL

SEQ ID NO: 568 - protein, 18 aa, Artificial Sequence
  Synthetic: Region 3
VVEIRHHHSEHRVHGAME

The invention claimed is:

1. An isolated antibody that binds specifically to human V-domain Ig Suppressor of T cell Activation (hVISTA), wherein the antibody binds to hVISTA in acidic pH conditions with a $K_D$ that is at least 10 fold lower than its $K_D$ in neutral or physiological pH conditions, wherein the antibody comprises heavy chain variable region (VH) complementarity-determining region 1 (CDR1), CDR2 and CDR3 of the VH of P1-061029_F100fE_V102D (positions 26-35, 50-66, and 99-112 of SEQ ID NO: 491), P1-061029_F100fE (positions 26-35, 50-66, and 99-112 of SEQ ID NO: 503), P1-061029_V102D (positions 26-35, 50-66, and 99-112 of SEQ ID NO: 515), P1-061029_Y32E (positions 26-35, 50-66, and 99-112 of SEQ ID NO: 527), or P1-061029_Y32E_F100fE (positions 26-35, 50-66, and 99-112 of SEQ ID NO: 539) and wherein the antibody comprises a light chain variable region (VL) comprising VL CDR1, CDR2 and CDR3 of the VL of P1-061029, wherein the VL CDR1, CDR2, and CDR3 of P1-061029 comprise amino acid positions 24-35, 51-57, and 90-98 of SEQ ID NO: 68.

2. The antibody of claim 1, wherein the antibody comprises the VH of P1-061029_F100fE_V102D (SEQ ID NO: 491), a VH with at least 95% identity to the VH of P1-061029_F100fE_V102D (SEQ ID NO: 491), P1-061029_F100fE (SEQ ID NO: 503), a VH with at least 95% identity to the VH of P1-061029_F100fE (SEQ ID NO: 503), P1-061029_V102D (SEQ ID NO: 515), a VH with at least 95% identity to the VH of P1-061029_V102D (SEQ ID NO: 515), P1-061029_Y32E (SEQ ID NO: 527), a VH with at least 95% identity to the VH of P1-061029_Y32E (SEQ ID NO: 527), P1-061029_Y32E_F100fE (SEQ ID NO: 539), or a VH with at least 95% identity to the VH of P1-061029_Y32E_F100fE (SEQ ID NO: 539).

3. The antibody of claim 1, wherein the antibody comprises the VH of P1-061029_F100fE_V102D (SEQ ID NO: 491), P1-061029_F100fE (SEQ ID NO: 503), P1-061029_V102D (SEQ ID NO: 515), P1-061029_Y32E (SEQ ID NO: 527), or P1-061029_Y32E_F100fE (SEQ ID NO: 539).

4. The antibody of claim 1, wherein the antibody comprises a VL comprising an amino acid sequence that is at least 95% identical to the amino acid sequence of SEQ ID NO: 68.

5. The antibody of claim 1, wherein the antibody comprises a VL comprising the amino acid sequence of SEQ ID NO: 68.

6. The antibody of claim 1, wherein the antibody binds to hVISTA in neutral or physiological pH conditions with a $K_D$ of $10^{-5}$ M or more, and wherein the antibody binds to hVISTA in acidic pH conditions with a $K_D$ of $10^{-8}$ M or less, and/or wherein the antibody binds to hVISTA in acidic pH conditions with a $k_{off}$ that is at least 10 fold lower than its $k_{off}$ in neutral or physiological pH conditions.

7. The antibody of claim 1, wherein acidic pH conditions are conditions having a pH of 6.5 or less or a pH of 6.0 to 6.5, neutral pH conditions are conditions having a pH of 7.0, and physiological pH conditions are conditions having a pH of 7.4.

8. The antibody of claim 6, wherein acidic pH conditions are conditions having a pH of 6.5 or less or a pH of 6.0 to 6.5, neutral pH conditions are conditions having a pH of 7.0, and physiological pH conditions are conditions having a pH of 7.4.

9. The antibody of claim 1, wherein the antibody has one or more of the following properties:
   binds to cyno VISTA;
   inhibits the binding of hVISTA to human T cells;
   inhibits the binding of hVISTA to human T cells in conditions having a pH of less than pH 7.0;
   inhibits the binding of hVISTA to huPSGL-1;
   inhibits the binding of hVISTA to huPSGL-1 in conditions having a pH of less than pH 7.0;
   inhibits the binding of hVISTA to heparan sulfate proteoglycans;
   inhibits the binding of hVISTA to heparan sulfate proteoglycans in conditions having a pH of less than pH 7.0;
   stimulates T cell activation;
   stimulates T cell activation in conditions having a pH of less than pH 7.0;
   reduces VISTA mediated cell-cell adhesion;
   stimulates the activity of VISTA;
   stimulates the binding of hVISTA to human T cells;
   stimulates the binding of hVISTA to human T cells in conditions having a pH of less than pH 7.0;
   stimulates the binding of hVISTA to huPSGL-1;
   stimulates the binding of hVISTA to huPSGL-1 in conditions having a pH of less than pH 7.0;

stimulates the binding of hVISTA to heparan sulfate proteoglycans;

stimulates the binding of hVISTA to heparan sulfate proteoglycans in conditions having a pH of less than pH 7.0;

has a mean residence time of at least 500 hours in Cynomolgus macaques;

does not significantly bind to VISTA positive cells in the peripheral blood of a subject to whom it is administered;

does not significantly deplete VISTA positive cells in peripheral blood of a subject to whom it is administered;

binds at or near the histidine-rich region of hVISTA;

binds at or near the histidine-rich region of hVISTA at a pH of 6.0 to 6.5;

does not bind significantly to hVISTA in which one or more of the following amino acid residues have been mutated: T35, Y37, K38, T39, Y41, R54, T61, F62, Q63, L65, H66, L67, H68, H69, F97, L115, V117, I119, H121, H122, S124, E125, R127;

contacts hVISTA at one or more of residues Y37, T39, R54, F62, H66, V117, I119 or S124;

binds to hVISTA at Region 1: $_{57}$LGPVDKGHDVTF$_{68}$; Region 2: $_{86}$RRPIRNLTFQDL$_{97}$; and Region 3: $_{148}$VVEIRHHHSEHRVHGAME$^{165}$ of hVISTA of SEQ ID NO: 1;

contacts H121, H122, and/or H123 of mature hVISTA; and has an isoelectric point (pI) between 6.5 and 6.8, as measured by icIEF.

10. The antibody of claim 1, which is an IgG1, IgG2 or IgG4 antibody, wherein the IgG4 antibody optionally has an S228P substitution in the heavy chain constant region.

11. A composition comprising the isolated antibody of claim 1 and a pharmaceutically acceptable carrier.

12. The antibody of claim 2, wherein the antibody comprises a VL comprising an amino acid sequence that is at least 95% identical to the amino acid sequence of SEQ ID NO: 68.

13. The antibody of claim 2, wherein the antibody comprises a VL comprising the amino acid sequence of SEQ ID NO: 68.

14. The antibody of claim 3, wherein the antibody comprises a VL comprising an amino acid sequence that is at least 95% identical to the amino acid sequence of SEQ ID NO: 68.

15. The antibody of claim 3, wherein the antibody comprises a VL comprising the amino acid sequence of SEQ ID NO: 68.

16. The antibody of claim 10, wherein the antibody is an effectorless antibody.

17. The antibody of claim 16, wherein the constant region comprises 1-5 mutations in a wild type heavy chain constant region that reduce the effector function of the antibody.

18. The antibody of claim 10, wherein the antibody has effector function.

19. The antibody of claim 1, wherein the antibody comprises a full-length heavy chain.

20. The antibody of claim 19, wherein the heavy chain lacks a C-terminal lysine residue.

21. The antibody of claim 1, wherein the antibody comprises a full-length light chain.

22. The antibody of claim 1, wherein the heavy chain comprises a heavy chain constant region comprising the amino acid sequence of SEQ ID NO: 163, 182, 183, or 184, optionally further comprising a C-terminal lysine residue.

23. The antibody of claim 1, wherein the heavy chain comprises a heavy chain constant region comprising the amino acid sequence of SEQ ID NO: 163, 182, 183, or 184 and optionally further comprising a C-terminal lysine residue, and wherein the light chain comprises a light chain constant region comprising the amino acid sequence of SEQ ID NO: 164.

24. The antibody of claim 1, wherein the antibody is an antibody fragment.

25. The antibody of claim 24, wherein the antibody fragment is a Fv, single-chain Fv (scFv), Fab, Fab', or (Fab')$_2$.

26. The antibody of claim 1, wherein the antibody is a bispecific or multispecific antibody.

27. The antibody of claim 1, which is linked to a label.

28. The antibody of claim 1, which is an antibody drug conjugate (ADC).

* * * * *

UNITED STATES PATENT AND TRADEMARK OFFICE
CERTIFICATE OF CORRECTION

| | |
|---|---|
| PATENT NO. | : 12,173,069 B2 |
| APPLICATION NO. | : 16/982277 |
| DATED | : December 24, 2024 |
| INVENTOR(S) | : Robert J. Johnston et al. |

It is certified that error appears in the above-identified patent and that said Letters Patent is hereby corrected as shown below:

In the Claims

In Claim 9, Column 287, Lines 20-23 should read:
-- I119, H121, H122, S124, E125, R127; contacts hVISTA at one or more of residues Y37, T39, R54, F62, H66, V117, I119 or S124; --

Signed and Sealed this
Fourth Day of March, 2025

Coke Morgan Stewart
*Acting Director of the United States Patent and Trademark Office*